United States Patent 7,745,391 (HUMAN THROMBOSPONDIN POLYPEPTIDE) - sequence listing, part 94

SEQ ID NO: 303094 - DNA, 3035 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgaggtgcggggccgggggcggctgggtcgtggggctccgcctgcgagctggctgtgtctgcggaggaggcggctggcggggtgggagcgggcggagtggggcgcgaggaggtggcggtggtggagagaagccgtcccacggagctcaggaccacgccaccatgttcagccagcagcagcagcagcagctccagcaacagcagcaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303095 - DNA, 2811 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccagtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303096 - DNA, 2901 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccaccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303097 - DNA, 2945 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgaggtgcggggccgggggcggctgggtcgtggggctccgcctgcgagctggctgtgtctgcggaggaggcggctggcggggtgggagcgggcggagtggggcgcgaggaggtggcggtggtggagagaagccgtcccacggagctcaggaccacgccaccatgttcagccagcagcagcagcagcagctccagcaacagcagcaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303098 - DNA, 3200 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggtaagtgagcactggctcccagctggtctggtgatgggacagctctgcccagacccttcattcctcccctgactgggtgctgcctgggactgagggctaggcctggaacccaggtccagggccatccatgctgggggcctcaaggttctggctgcggacggagaaggcagctcttgggcctggggactctgggaaatacagcacatctgtcatttcaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303099 - DNA, 2680 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303100 - DNA, 2643 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303101 - DNA, 2169 bp, Homo sapiens
aaacatacggctaggtacgaggcctgggttaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303102 - DNA, 2958 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303103 - DNA, 2750 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgggccacaggatctgttcccagatcacgacgctagtcaaagcgacag

SEQ ID NO: 303104 - DNA, 2691 bp, Homo sapiens
  misc_feature (2616)..(2616): n is a, c, g, or t
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccatntaaaaagaataagacaagaattaataaagcggccagaatctagtttaaatcgagatatgtgagccgccggtgcgc

SEQ ID NO: 303105 - DNA, 2785 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgctggggggagggtgtgggaggcgggcttggtgctggattcccagcccaggacagacctcatcccacctcccggaggccagacactgggctggcatctgtgggcactaatgcatgccacaactgattactgtcaactgccttctgcatgactatgtaattatgcatgatgactagagagtggcagttaaaatatgcaaagcctgactgaaatttggacctgtgtggaggaagggaaagggaacagcatcagtaaaggcacggaggtgggaaactatgtagtgtgcaaaggaaaagtcagatgatggtgatgataatggagagactga

SEQ ID NO: 303106 - DNA, 1796 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccaattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303107 - DNA, 2816 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303108 - DNA, 2377 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303109 - DNA, 2110 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctgggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303110 - DNA, 1564 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccagtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccctggccagagcactgtggcacccaagtcagcatgggaccgacattgggatcctctagataag

SEQ ID NO: 303111 - DNA, 1791 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303112 - DNA, 1486 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccaccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagaaggtcgacggagatcctgctagagt

SEQ ID NO: 303113 - DNA, 1563 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303114 - DNA, 1750 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303115 - DNA, 1529 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagctgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttg

SEQ ID NO: 303116 - DNA, 901 bp, Homo sapiens
ggctggtctggtcgggattttgggatccaggccccggagtagcagcggggaggccgggagcccgcgggccggagccgcccggccgaggcgtgggggctgcggggccggcccatccgtgggggcgacttgagcgttgagggcgcgcggggaggcgagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaagtgcgcctgggtgcgcacccatggcgcacttctggggcagccatttgaggtggcatatgggatgcatgttgggtcacgtaagtgaataggaaaagaaagggactgaaagcatttaacaggagacaacctcacaaatctgtgggggtgatgaatgctggtcaaggggccaaggtggagaagtgcgcctgggtg

SEQ ID NO: 303117 - DNA, 321 bp, Homo sapiens
tccgatttgtgtgctcgatcaacctagccctgtttctcagtgctgttttgctaatatctctaatagtcttacttaatcttgttgaaagtagcacttttgaggttaataaggtttaaattaataacccccattgactgtagtctataatactataattttttaaatggcaaaatgccctctgggagctaaggtgtcttaaaagcttagagcaaatcctgttaaatgggacaaagtcacgaatcaagttaatggacaaggagaacccacttggatgtactgtaccgagggtgatggatgtcagcaagccaattacagattatt

SEQ ID NO: 303118 - DNA, 1340 bp, Homo sapiens
tccgatttgtgtgctcgatcaacctagccctgtttctcagtgctgttttgctaatatctctaatagtcttacttaatcttgttgaaagtagcacttttgaggttaataaggtttaaattaataacccccattgactgtagtctataatactataattttttaaatggcaaaatgccctctgggagctaaggtgtcttaaaagcttagagcaaatcctgttaaatgggacaaagtctcaattcttttttaataagacaaaaacactttatgtagtctcttttctttttcagtgtttctcgaaatttcaattttattccatgctgctacagaatacaaacttacccaataaaaatagcagctccattgaaagagctttcccacaaattgaaatatttaaagcacagttacaggcttgtgtactgttggtgcatacattgtttgatttgttcagttcctcagttttgcagggaaagatgtcaacattatctgatttttcaagctatctattcaatgattctaattttctaaaagacttggaagctgggttgttttttgttctggcccctcagtttgttgagagcctattttaaagatttccggtggatttaacaaaatgaacaaaatttagaggactcatttatttcccccaaccaagtcagtgccatagtgggacccttacataaatttgtcactgtgtttaaatttgatgtagtgaatgaaaataatcatctgaagccagtataaaataggcattaaacattgttgtccaagctagagtgcagtggctctccaccagcatgatcatttaacacacaaaaacctgaaacacctgggcttaatcctgcctcagccttccgagtagctgggactacaggcacatgccactatgccttgttaaattaagatttgtagctcttcttcccattccctgcacccttctgagagagcttatactgaaagttctgcattttgtgtccttgattttgcacaggaaggcaaaagatcacagttgaggaaaaaaagttacccactttgaaaatctgtttccatttttaaattcctgtagttatagggaataagttgttctagtagaccaaaagaagattaatgtttttagttatacacggatgcattgatattgtggtagacagttgatactggctttatcgtaatttttttttctttttatggagaatggggtctcactatgttatccaagctggtctcgaactcctgcgctcaagctgtcctctcgcctctgcttctctgttgtatcttttttatttaggcatcctttcttttgctttctagtacttggtcttttgtatatgaatacgttc

SEQ ID NO: 303119 - DNA, 4730 bp, Homo sapiens
cgggagacattcgaggcggacagaaacggggcttggcgccccccggtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtgatccctgccatgctatctgctctgctcagcgactgaaggtgcccgcatcccagctctgccaggaagcaaaggtaagttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaatgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcaggatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggctcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccacccaaatgtcccctgctccagtcccactcctgtcaccccacgctctgcactggggagaaaacgggaggtgctcgtgctggccctgggtgggagcggggagtcctggtgagaccccggtgagatggaccatcctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 303120 - DNA, 5043 bp, Homo sapiens
  misc_feature (4738)..(4738): n is a, c, g, or t
  misc_feature (4752)..(4752): n is a, c, g, or t
cgggagacattcgaggcggacagaaacggggcttggcgccccccggtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtgatccctgccatgctatctgctctgctcagcgactgaaggtgcccgcatcccagctctgccaggaagcaaaggtaagttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaatgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcaggatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggctcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccacccaaatgtcccctgctccagtcccactcctgtcaccccacgctctgcactggggagaaaacgggaggtgctcgtgctggccctgggtgggagcggggagtcctggtgagaccccggtgagatggaccatcctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagcaaaaaacanaaacaacaaaaaanaaccacagggggggcccaacaaaaaaactcccccaaaggggccaaccaaacgcgaaaccacaaaaccaagcgacccaacggggcccacaaacggaaaacagaaaaaaacaccaagcacaggggccacggagacacagaaaagcagagaaagggaaaaaaagggcaaaacagagaacacatagaaaaggaacccaaacaccaagagagaggacaacacaaccgggcaacaacaaccccacaaaacaacttaaaaggccaaaagggaaacacaaaaaaaaagaacgggacaaa

SEQ ID NO: 303121 - DNA, 4088 bp, Homo sapiens
gcagatccgagataagtatgggctgaagaagaaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaatgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcaggatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggctcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccacccaaatgtcccctgctccagtcccactcctgtcaccccacgctctgcactggggagaaaacgggaggtgctcgtgctggccctgggtgggagcggggagtcctggtgagaccccggtgagatggaccatcctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 303122 - DNA, 4549 bp, Homo sapiens
agctggaatagcagaaggaaccacctcgtggagtcgggccggagccctgcagtggctcagacggttgcagggaccgccaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaatgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcaggatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggctcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccacccaaatgtcccctgctccagtcccactcctgtcaccccacgctctgcactggggagaaaacgggaggtgctcgtgctggccctgggtgggagcggggagtcctggtgagaccccggtgagatggaccatcctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 303123 - DNA, 4593 bp, Homo sapiens
cgagctcggtacccaacgcgcttgattagcctcccaacaggaaggtgtgatccctgccatgctatctgctctgctcagcgactgaaggtgcccgcatcccagctctgccaggaagcaaaggtaagttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaatgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcaggatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggctcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccacccaaatgtcccctgctccagtcccactcctgtcaccccacgctctgcactggggagaaaacgggaggtgctcgtgctggccctgggtgggagcggggagtcctggtgagaccccggtgagatggaccatcctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 303124 - DNA, 3165 bp, Homo sapiens
cgggagacattcgaggcggacagaaacggggcttggcgccccccggtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtgatccctgccatgctatctgctctgctcagcgactgaaggtgcccgcatcccagctctgccaggaagcaaaggtaagttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaatgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 303125 - DNA, 3014 bp, Homo sapiens
cgggagacattcgaggcggacagaaacggggcttggcgccccccggtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtgatccctgccatgctatctgctctgctcagcgactgaaggtgcccgcatcccagctctgccaggaagcaaaggtaagttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaatgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgtatgatgcaaatgctgaaatgtacaaaatcaaccatgacaacaaagaaaaagaccttgtacagca

SEQ ID NO: 303126 - DNA, 971 bp, Homo sapiens
ctggaaaccctggattcaaggagagaacccagatcgacattgaaggagcaatcatttgtagatgggtgaaaaaagaatgaggttcaagggagcgtgcaccaggtgaggtgagcgtgtgtgctctcagggaagggcccaggctcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccacccaaatgtcccctgctccagtcccactcctgtcaccccacgctctgcactggggagaaaacgggaggtgctcgtgctggccctgggtgggagcggggagtcctggtgagaccccggtgagatggaccatcctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 303127 - DNA, 855 bp, Homo sapiens
ttcctcatggctgactctagaggatacacaactcaggggcgagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccacccaaatgtcccctgctccagtcccactcctgtcaccccacgctctgcactggggagaaaacgggaggtgctcgtgctggccctgggtgggagcggggagtcctggtgagaccccggtgagatggaccatcctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 303128 - DNA, 1530 bp, Homo sapiens
cgggagacattcgaggcggacagaaacggggcttggcgccccccggtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtgatccctgccatgctatctgctctgctcagcgactgaaggtgcccgcatcccagctctgccaggaagcaaaggtaagttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcaggatgcggggcaggggtggaatgtgtcattacttggctggctggggagagtggtacggcgcggctgcagccagcaacgcgacgcacgatccgtcgcgcgcccgcccacacaccatcactgcacgcgaccgctaccaggcgcggcgacgcggggtggtgagccgacccccagagccggagcggcaacgagccgccaggcgaaccggacaagaccaaacggacaacacagcaaactaccgcggaagacgcggagagcaaaacgtagcgatcacgcgggcccaacagtcgcacgaacttccgccacccccacgagaccgacgccaaacccatacgaaccagaggactaataaacgacgtc

SEQ ID NO: 303129 - DNA, 697 bp, Homo sapiens
  misc_feature (37)..(37): n is a, c, g, or t
  misc_feature (53)..(53): n is a, c, g, or t
aatggaacaggggaaatttggtgggaggcatgtcctnaggcctgggagaccangctggccccagcctccctgtgcggtcaggggcctgtggaaccctggaggatacagaagtattgcagcccagatcccctatcagggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccacccaaatgtcccctgctccagtcccactcctgtcaccccacgctctgcactggggagaaaacgggaggtgctcgtgctggccctgggtgggagcggggagtcctggtgagaccccggtgagatggaccatcctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 303130 - DNA, 598 bp, Homo sapiens
ctctagaggatcttccgggggccttatcccctatcagggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccacccaaatgtcccctgctccagtcccactcctgtcaccccacgctctgcactggggagaaaacgggaggtgctcgtgctggccctgggtgggagcggggagtcctggtgagaccccggtgagatggaccatcctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 303131 - DNA, 523 bp, Homo sapiens
agctggaatagcagaaggaaccacctcgtggagtcgggccggagccctgcagtggctcagacggttgcagggaccgccaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccgggccattcaacgcctccgggccattcaacgcctccgggccattcaacgcctccgggccattca

SEQ ID NO: 303132 - DNA, 4795 bp, Homo sapiens
aaatttgcaattttatattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggccgcagcctcggccccggcgcgcccccggcagctctcggcgcgatgagcatagagacgctactggaggcggcccgcttcctggaatggcaagcgcagcaacaacagagagcacgtgaggagcaggagcggcttcgcttggagcaggagcgagagcaggaacagaagaaggccaatagcctggccaggctggcacatacccttcctgtggaggaaccccgcatggaggcgccacccctgcctctgtctccaccggctcccccgccggcacccccaccaccacttgccacccctgccccactgactgtcatccctatccctgtggtgaccaactcccctcagcctctacccccacccccacccttgcccgcggcagcccagcctctgcccctggcgcctcgtcagccggccctggttggcgcccccggactcagcattaaggagcctgcccccctgcccagcaggccgcaggtgcccacccctgctcccctactgccggactcgaaggccaccattccacccaatggcagccccaagcctttgcagcccctccccacgcctgtcctgaccatagcgccacaccctggagtccagcctcagctggccccccagcagccgcccccacccacgctggggaccctgaagttggcaccagctgaagaagtcaaatccagtgaacagaagaagaggcccggggggatcggaaccagagaagtccacaacaaattggagaagaacaggagggcccatctgaaagagtgctttgagaccctgaagcggaacatccccaacgtggatgacaagaagacgtccaatctgagcgtgctgcggacggcgctgcggtacatccagtccctgaagaggaaggagaaggaatatgagcatgaaatggagcggctggcacgtgagaagattgccacgcagcagcggctggcagagctcaagcacgagctgagccagtggatggacgtactggagattgaccgcgtgctgcggcagacgggccagcccgaggatgaccaggcctccacctccaccgcctctgagggtgaggacaacatagacgaggatatggaggaggaccgggcgggcctgggcccacctaagctgagccatcgtccccagccggagctgctgaagtccaccctgccaccccccagcaccacccctgcgcctctgcctccacacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctccacggtcatcgcccacacagctaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgccaccctcaaccatgtggcccacctgggctcccagctgcccttgtacccgcagcccgtggcagtgagccacatcgcccacaccctctcgcaccagcaagtcaacggcacggccggcctggggcccccggctactgtcatggcaaagccggccgtgggggctcaggtggtgcaccacccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccaggcccaggccagcccccccacccacccccaggcctcctaggggaagggggtgcaaagactctgagccaagggagggaagggccaccctgctgcactaggacttggtaagatgactctgagaaaatgcgagactctgatggaatgtgccacctgtccggcccagtgccagctccagtgccgctcctgcttcccctccctaccctcggaaatcagtgcgatgtggacgtcacgctccctgacttcttcccccggccctgccccggccttcgtgtgctgctgctgctattgctgtctggtgaaggtggcccaggcccccggctttcctccggagcctcatgttctcttcccaggcctttggaggggaaatggggaaagcagaactgaagccacttggcccagaaagctgcggattggggtgataaggggccttgctctgagcacaggtgacagatcataggaagtggctggtctggagtcccacccggacaggtggggcctcagcctggggctctctgacccggttgcagtcactgtgattcgttaccgtagatactacttaaaatgattctctaccaacaataaaccaaacccagccactgccaagcttcctgtgccctcaccccaatccctgccactgggctctggacctcaggagggcaggctgaggtggggaaggagggacttggctgtccttccccttccccgtcccctgcagcctgggtctggatgggaggagagccactgggcccctgtcgtccccagtccccagccctgggcttggctcttggcttccagaaggcagcaaagaggggcgctgtcctgcgttcagcccctgatctctgacctctgctgagtgctgggcactgctccaagggacaggtgggcctggcggcctgtgggtttgggtgcctcctgcagtttgggagacatggaccagcatctggtcttgtttccaggagcatagaagccacatcgttgagacatcaggaaggtaaaaacccagcggcttagccaagccctaagcctgtccccagaccaaccctgggacctatacagaacagagggccagagctagggctgctgcttctgctccagcccctttgcctctgtcctcccatcccctcaacaccctgcttctcccggggacgcttttgagtgggccctgcccggggagctgcagagcagcagcacctttctctgagaagaggtccttggttgggtcaaggacagggctgagcgtggaagggggaggagtcaggggctctgtgttaggatgcggctttctctgcctctgggcagcctgctttggcctttccttgtatgtgggtgtttattacaagtggctttgtgtcagacacgctcggctccccacctggacacacactcaccagtggcctttcagtgtagcgggaggaagccggtgtccctggatgtgaagctcacactgatgggctggggcaggggcctgggccggcgagggggccggggggaggggacagagctgaggatttcctggagtgccctgcaggcacagaggaggtcagcaaaggtcttgaatagattttctctggaaataaagaatccttagatgcctaaaaattcccttcctgttccctcctggtcctggacacctcccaggggactgttccttatttctctctcctggtgtgggtaaagggacagttacaaaccaggtcaccatcctcagaggctgagccctgtacccaccccagcacagccacctccgccagaccccgtggctctgggagagccagctttgctattcccattgtgacagcgatggcaggcctgacccacggggcagttagagcagcctcgtggagctcgcccctcccctcagcctgcccacctctccctgcatcctgaggccagtggcccccgggcctgcacagatacctcatcatccacccgctgcccctccccgtccctgtcccccagcatcgggggcctgcaaatctagtgccgaatgactatgtccagattggtgacgatgggtgttgctgtttttcttgtcgtttgtgaacgctgtgatgctgtgtgcccaagtgggcagtcaccacccagcccttccttgggcgtctcccccagagtgctgtcgggaccacatctgtcctcaccctgtgggaccgcctggccctccctccctagcccttccagcctgggacacacacacacacacacacacacacacacacacacgcacgcacacgcacacatcttacctctcatgcgtgttttaccttttgatgttcagagtggctcactggctgggagtccttacctcggggagagggggaggttggttccttggggggccaaagaaggcagggaatgcctggagggtaactggggggccaccatgaccccttctctctccagaaacagctgcttctccccccatcccagggtcccacccccaacccccagaggtggcccttgtttacagtgaggactcggccactgtgtctctgtttcctgaaatataaactgtagcgaccccagactgtagagatttttatgtgtttggatacatctgctgtgtggaaaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctga

SEQ ID NO: 303133 - DNA, 473 bp, Homo sapiens
tagggggtcggggagcaggtgcagaccagcagccaggagggaggcgagtcctggagatgagatggggcgagggcgtgtcactgcctagtggctcatcgtgcaaggatgttgatgttaccagggagacaagtgaacggtgaggtggaagcgcaggatcaggttccttagagggtagctcgcggcagaagtgtgcaaagtgaagaggctgctggaggagggatggggcgagaggcggagaagcccctgaggatgaattgtggaggactgctcagggtgtcctgctgtcccttactctgtgtgccagtccctgaagaggaaggagaaggaatatgagcatgaaatggagcggctggcacgtgagaagattgccacgcagcagcggctggcagagctcaagcaagattttgccgtcccattcccattttttcctttacaattttaaacaagtttcttcattaaaaactatggtgatg

SEQ ID NO: 303134 - DNA, 4080 bp, Homo sapiens
tagggggtcggggagcaggtgcagaccagcagccaggagggaggcgagtcctggagatgagatggggcgagggcgtgtcactgcctagtggctcatcgtgcaaggatgttgatgttaccagggagacaagtgaacggtgaggtggaagcgcaggatcaggttccttagagggtagctcgcggcagaagtgtgcaaagtgaagaggctgctggaggagggatggggcgagaggcggagaagcccctgaggatgaattgtggaggactgctcagggtgtcctgctgtcccttactctgtgtgccagtccctgaagaggaaggagaaggaatatgagcatgaaatggagcggctggcacgtgagaagattgccacgcagcagcggctggcagagctcaagcacgagctgagccagtggatggacgtactggagattgaccgcgtgctgcggcagacgggccagcccgaggatgaccaggcctccacctccaccgcctctgagggtgaggacaacatagacgaggatatggaggaggaccgggcgggcctgggcccacctaagctgagccatcgtccccagccggagctgctgaagtccaccctgccaccccccagcaccacccctgcgcctctgcctccacacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctccacggtcatcgcccacacagctaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgccaccctcaaccatgtggcccacctgggctcccagctgcccttgtacccgcagcccgtggcagtgagccacatcgcccacaccctctcgcaccagcaagtcaacggcacggccggcctggggcccccggctactgtcatggcaaagccggccgtgggggctcaggtggtgcaccacccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccaggcccaggccagcccccccacccacccccaggcctcctaggggaagggggtgcaaagactctgagccaagggagggaagggccaccctgctgcactaggacttggtaagatgactctgagaaaatgcgagactctgatggaatgtgccacctgtccggcccagtgccagctccagtgccgctcctgcttcccctccctaccctcggaaatcagtgcgatgtggacgtcacgctccctgacttcttcccccggccctgccccggccttcgtgtgctgctgctgctattgctgtctggtgaaggtggcccaggcccccggctttcctccggagcctcatgttctcttcccaggcctttggaggggaaatggggaaagcagaactgaagccacttggcccagaaagctgcggattggggtgataaggggccttgctctgagcacaggtgacagatcataggaagtggctggtctggagtcccacccggacaggtggggcctcagcctggggctctctgacccggttgcagtcactgtgattcgttaccgtagatactacttaaaatgattctctaccaacaataaaccaaacccagccactgccaagcttcctgtgccctcaccccaatccctgccactgggctctggacctcaggagggcaggctgaggtggggaaggagggacttggctgtccttccccttccccgtcccctgcagcctgggtctggatgggaggagagccactgggcccctgtcgtccccagtccccagccctgggcttggctcttggcttccagaaggcagcaaagaggggcgctgtcctgcgttcagcccctgatctctgacctctgctgagtgctgggcactgctccaagggacaggtgggcctggcggcctgtgggtttgggtgcctcctgcagtttgggagacatggaccagcatctggtcttgtttccaggagcatagaagccacatcgttgagacatcaggaaggtaaaaacccagcggcttagccaagccctaagcctgtccccagaccaaccctgggacctatacagaacagagggccagagctagggctgctgcttctgctccagcccctttgcctctgtcctcccatcccctcaacaccctgcttctcccggggacgcttttgagtgggccctgcccggggagctgcagagcagcagcacctttctctgagaagaggtccttggttgggtcaaggacagggctgagcgtggaagggggaggagtcaggggctctgtgttaggatgcggctttctctgcctctgggcagcctgctttggcctttccttgtatgtgggtgtttattacaagtggctttgtgtcagacacgctcggctccccacctggacacacactcaccagtggcctttcagtgtagcgggaggaagccggtgtccctggatgtgaagctcacactgatgggctggggcaggggcctgggccggcgagggggccggggggaggggacagagctgaggatttcctggagtgccctgcaggcacagaggaggtcagcaaaggtcttgaatagattttctctggaaataaagaatccttagatgcctaaaaattcccttcctgttccctcctggtcctggacacctcccaggggactgttccttatttctctctcctggtgtgggtaaagggacagttacaaaccaggtcaccatcctcagaggctgagccctgtacccaccccagcacagccacctccgccagaccccgtggctctgggagagccagctttgctattcccattgtgacagcgatggcaggcctgacccacggggcagttagagcagcctcgtggagctcgcccctcccctcagcctgcccacctctccctgcatcctgaggccagtggcccccgggcctgcacagatacctcatcatccacccgctgcccctccccgtccctgtcccccagcatcgggggcctgcaaatctagtgccgaatgactatgtccagattggtgacgatgggtgttgctgtttttcttgtcgtttgtgaacgctgtgatgctgtgtgcccaagtgggcagtcaccacccagcccttccttgggcgtctcccccagagtgctgtcgggaccacatctgtcctcaccctgtgggaccgcctggccctccctccctagcccttccagcctgggacacacacacacacacacacacacacacacacacacgcacgcacacgcacacatcttacctctcatgcgtgttttaccttttgatgttcagagtggctcactggctgggagtccttacctcggggagagggggaggttggttccttggggggccaaagaaggcagggaatgcctggagggtaactggggggccaccatgaccccttctctctccagaaacagctgcttctccccccatcccagggtcccacccccaacccccagaggtggcccttgtttacagtgaggactcggccactgtgtctctgtttcctgaaatataaactgtagcgaccccagactgtagagatttttatgtgtttggatacatctgctgtgtggaaaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctga

SEQ ID NO: 303135 - DNA, 4498 bp, Homo sapiens
aaatttgcaattttatattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggccgcagcctcggccccggcgcgcccccggcagctctcggcgcgatgagcatagagacgctactggaggcggcccgcttcctggaatggcaagcgcagcaacaacagagagcacgtgaggagcaggagcggcttcgcttggagcaggagcgagagcaggaacagaagaaggccaatagcctggccaggctggcacatacccttcctgtggaggaaccccgcatggaggcgccacccctgcctctgtctccaccggctcccccgccggcacccccaccaccacttgccacccctgccccactgactgtcatccctatccctgtggtgaccaactcccctcagcctctacccccacccccacccttgcccgcggcagcccagcctctgcccctggcgcctcgtcagccggccctggttggcgcccccggactcagcattaaggagcctgcccccctgcccagcaggccgcaggtgcccacccctgctcccctactgccggactcgaaggccaccattccacccaatggcagccccaagcctttgcagcccctccccacgcctgtcctgaccatagcgccacaccctggagtccagcctcagctggccccccagcagccgcccccacccacgctggggaccctgaagttggcaccagctgaagaagtcaaatccagtgaacagaagaagaggcccggggggatcggaaccagagaagtccacaacaaattggagaagaacaggagggcccatctgaaagagtgctttgagaccctgaagcggaacatccccaacgtggatgacaagaagacgtccaatctgagcgtgctgcggacggcgctgcggtacatccagtccctgaagaggaaggagaaggaatatgagcatgaaatggagcggctggcacgtgagaagattgccacgcagcagcggctggcagagctcaagcacgagctgagccagtggatggacgtactggagattgaccgcgtgctgcggcagacgggccagcccgaggatgaccaggcctccacctccaccgcctctgagggtgaggacaacatagacgaggatatggaggaggaccgggcgggcctgggcccacctaagctgagccatcgtccccagccggagctgctgaagtccaccctgccaccccccagcaccacccctgcgcctctgcctccacacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctccacggtcatcgcccacacagctaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgccaccctcaaccatgtggcccacctgggctcccagctgcccttgtacccgcagcccgtggcagtgagccacatcgcccacaccctctcgcaccagcaagtcaacggcacggccggcctggggcccccggctactgtcatggcaaagccggccgtgggggctcaggtggtgcaccacccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccaggcccaggccagcccccccacccacccccaggcctcctaggggaagggggtgcaaagactctgagccaagggagggaagggccaccctgctgcactaggacttggtaagatgactctgagaaaatgcgagactctgatggaatgtgccacctgtccggcccagtgccagctccagtgccgctcctgcttcccctccctaccctcggaaatcagtgcgatgtggacgtcacgctccctgacttcttcccccggccctgccccggccttcgtgtgctgctgctgctattgctgtctggtgaaggtggcccaggcccccggctttcctccggagcctcatgttctcttcccaggcctttggaggggaaatggggaaagcagaactgaagccacttggcccagaaagctgcggattggggtgataaggggccttgctctgagcacaggtgacagatcataggaagtggctggtctggagtcccacccggacaggtggggcctcagcctggggctctctgacccggttgcagtcactgtgattcgttaccgtagatactacttaaaatgattctctaccaacaataaaccaaacccagccactgccaagcttcctgtgccctcaccccaatccctgccactgggctctggacctcaggagggcaggctgaggtggggaaggagggacttggctgtccttccccttccccgtcccctgcagcctgggtctggatgggaggagagccactgggcccctgtcgtccccagtccccagccctgggcttggctcttggcttccagaaggcagcaaagaggggcgctgtcctgcgttcagcccctgatctctgacctctgctgagtgctgggcactgctccaagggacaggtgggcctggcggcctgtgggtttgggtgcctcctgcagtttgggagacatggaccagcatctggtcttgtttccaggagcatagaagccacatcgttgagacatcaggaaggtaaaaacccagcggcttagccaagccctaagcctgtccccagaccaaccctgggacctatacagaacagagggccagagctagggctgctgcttctgctccagcccctttgcctctgtcctcccatcccctcaacaccctgcttctcccggggacgcttttgagtgggccctgcccggggagctgcagagcagcagcacctttctctgagaagaggtccttggttgggtcaaggacagggctgagcgtggaagggggaggagtcaggggctctgtgttaggatgcggctttctctgcctctgggcagcctgctttggcctttccttgtatgtgggtgtttattacaagtggctttgtgtcagacacgctcggctccccacctggacacacactcaccagtggcctttcagtgtagcgggaggaagccggtgtccctggatgtgaagctcacactgatgggctggggcaggggcctgggccggcgagggggccggggggaggggacagagctgaggatttcctggagtgccctgcaggcacagaggaggtcagcaaaggtcttgaatagattttctctggaaataaagaatccttagatgcctaaaaattcccttcctgttccctcctggtcctggacacctcccaggggactgttccttatttctctctcctggtgtgggtaaagggacagttacaaaccaggtcaccatcctcagaggctgagccctgtacccaccccagcacagccacctccgccagaccccgtggctctgggagagccagctttgctattcccattgtgacagcgatggcaggcctgacccacggggcagttagagcagcctcgtggagctcgcccctcccctcagcctgcccacctctccctgcatcctgaggccagtggcccccgggcctgcacagatacctcatcatccacccgctgcccctccccgtccctgtcccccagcatcgggggcctgcaaatctagtgccgaatgactatgtccagattggtgacgatgggtgttgctgtttttcttgtcgtttgtgaacgctgtgatgctgtgtgcccaagtgggcagtcaccacccagcccttccttgggcgtctcccccagagtgctgtcgggaccacatctgtcctcaccctgtgggaccgcctggccctccctccctagcccttccagcctgggacacacacacacacacacacacacacacacacacacgcacgcacacgcacacatcttacctctcatgcgtgttttaccttttgatgttcagagtggctcactggctgggagtccttacctcggggagagggggaggctcctccttcctctcctctcctcctccttctctcatacccacccactctctatcacaccctccttatcttccttctatttcttctcccatctcatccttccttcattttacccacttccgcatctctt

SEQ ID NO: 303136 - DNA, 3283 bp, Homo sapiens
aaatttgcaattttatattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggccgcagcctcggccccggcgcgcccccggcagctctcggcgcgatgagcatagagacgctactggaggcggcccgcttcctggaatggcaagcgcagcaacaacagagagcacgtgaggagcaggagcggcttcgcttggagcaggagcgagagcaggaacagaagaaggccaatagcctggccaggctggcacatacccttcctgtggaggaaccccgcatggaggcgccacccctgcctctgtctccaccggctcccccgccggcacccccaccaccacttgccacccctgccccactgactgtcatccctatccctgtggtgaccaactcccctcagcctctacccccacccccacccttgcccgcggcagcccagcctctgcccctggcgcctcgtcagccggccctggttggcgcccccggactcagcattaaggagcctgcccccctgcccagcaggccgcaggtgcccacccctgctcccctactgccggactcgaaggccaccattccacccaatggcagccccaagcctttgcagcccctccccacgcctgtcctgaccatagcgccacaccctggagtccagcctcagctggccccccagcagccgcccccacccacgctggggaccctgaagttggcaccagctgaagaagtcaaatccagtgaacagaagaagaggcccggggggatcggaaccagagaagtccacaacaaattggagaagaacaggagggcccatctgaaagagtgctttgagaccctgaagcggaacatccccaacgtggatgacaagaagacgtccaatctgagcgtgctgcggacggcgctgcggtacatccagtccctgaagaggaaggagaaggaatatgagcatgaaatggagcggctggcacgtgagaagattgccacgcagcagcggctggcagagctcaagcacgagctgagccagtggatggacgtactggagattgaccgcgtgctgcggcagacgggccagcccgaggatgaccaggcctccacctccaccgcctctgagggtgaggacaacatagacgaggatatggaggaggaccgggcgggcctgggcccacctaagctgagccatcgtccccagccggagctgctgaagtccaccctgccaccccccagcaccacccctgcgcctctgcctccacacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctccacggtcatcgcccacacagctaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgccaccctcaaccatgtggcccacctgggctcccagctgcccttgtacccgcagcccgtggcagtgagccacatcgcccacaccctctcgcaccagcaagtcaacggcacggccggcctggggcccccggctactgtcatggcaaagccggccgtgggggctcaggtggtgcaccacccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccaggcccaggccagcccccccacccacccccaggcctcctaggggaagggggtgcaaagactctgagccaagggagggaagggccaccctgctgcactaggacttggtaagatgactctgagaaaatgcgagactctgatggaatgtgccacctgtccggcccagtgccagctccagtgccgctcctgcttcccctccctaccctcggaaatcagtgcgatgtggacgtcacgctccctgacttcttcccccggccctgccccggccttcgtgtgctgctgctgctattgctgtctggtgaaggtggcccaggcccccggctttcctccggagcctcatgttctcttcccaggcctttggaggggaaatggggaaagcagaactgaagccacttggcccagaaagctgcggattggggtgataaggggccttgctctgagcacaggtgacagatcataggaagtggctggtctggagtcccacccggacaggtggggcctcagcctggggctctctgacccggttgcagtcactgtgattcgttaccgtagatactacttaaaatgattctctaccaacaataaaccaaacccagccactgccaagcttcctgtgccctcaccccaatccctgccactgggctctggacctcaggagggcaggctgaggtggggaaggagggacttggctgtccttccccttccccgtcccctgcagcctgggtctggatgggagggggacctgtcccccactctctcacccaccagctccacacattccatgccagtgcccaggccatgcccccccccaaaccagcacgccaaggtcctcacataggggaaatatggtggtgcataagaagacatgagacaatggaaaggtacatgcaaaaatcttaagtagcacgagatgatgctaccttttcgcgagacactttgggtagatcagaaaatcgcgctgtaggcctgggataagaaccgatggttacggtgaccggagacccagcgatagataaattagccatggttgtaggcccagagacggattggagacagatcacctcaagacacaagaagtcagaacccctctaggtggagtgacatacccgccaaacaagtcggattggatgaaggatcgaaaaatcacgaggtcgcacaggagttgtttagagagcaccgtacagaagaccatgaaggctaacagaaagactccattaacaacaacttgtgcaagac

SEQ ID NO: 303137 - DNA, 841 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagagtaagtgctactttctaggtagtaggtacattatcagtctgtgtggagacagccttcttatggatagctaataggataatatgtagtattttcttaaccagatcctattccactgtaattaacattagacctttccctttacccccattgaaggtggtggaaaaaaggaattagaaggggaaggaagagttttcagaggggtatttctgggcaaataattaatagaaccaaagttgcaaagtaggaattcattttcatttgttttaatgggtggagaaaattggaataaagtaggtgttactacctgcttctgtag

SEQ ID NO: 303138 - DNA, 537 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaagacactgaaattgaggaagagagattttggcgttctgttggtttatggagagagttgatcagagattgctccttggctgagttgctgtctgcataggctgttaacaattgtttctctggcagcagatcttgttcatcaggattgcatcatttctgggagaatggccaaggtccacagcctcaatacaaagactgtctgaagcatatgaggcctgttctctttctgaagcggcactcctcttcctgccagtcctcttcaca

SEQ ID NO: 303139 - DNA, 6843 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303140 - DNA, 6882 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaaggcatttcgagagggatcccggaagtccttgcggatgaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303141 - DNA, 6900 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctgatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303142 - DNA, 6612 bp, Homo sapiens
tgatacagagactgttggccatttctgaaaccaattaaaaagatggggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303143 - DNA, 7229 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaagtaagaacgtcattcattgagcagtgagggctaaggtggacctggttgaccagtgttgttgtaaaaatcattctgtttgataagacgctcttgggagaaaaaaatcacaactcagataagctcacacctgtctgctatttgtagagaagtgcaagtaaatcttcaaattgttcaatgtataaaatggtgacacctcctttccaagccaagcattccttgctttgtgcttgttctttaatcaaaagcagacaaacgtgatgctttcccaagtttaggcgttgcaaaagactgctgctgcttctctcagcatatgcttcatatttggagtcatggggtggccttcttatttgtgttgagaattacaggaattttaattgtatccctagaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303144 - DNA, 6430 bp, Homo sapiens
ctgagtctaaaccagcccagagtggcttctctaggggaaactccccgctcagctgccctgaatctgtggaggctagtccagcagttaatgagaagagcgtgtattccactcataattatgggaccactcagaggcatgggtgtcgaggactgccttatgctgatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303145 - DNA, 6052 bp, Homo sapiens
gcatgttttccttaattatgaagtaatttgagtgtctactaaggtgttcttgctgttgtttaatgttattgctctggttttattcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaagtaagaacgtcattcattgagcagtgagggctaaggtggacctggttgaccagtgttgttgtaaaaatcattctgtttgataagacgctcttgggagaaaaaaatcacaactcagataagctcacacctgtctgctatttgtagagaagtgcaagtaaatcttcaaattgttcaatgtataaaatggtgacacctcctttccaagccaagcattccttgctttgtgcttgttctttaatcaaaagcagacaaacgtgatgctttcccaagtttaggcgttgcaaaagactgctgctgcttctctcagcatatgcttcatatttggagtcatggggtggccttcttatttgtgttgagaattacaggaattttaattgtatccctagaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303146 - DNA, 5396 bp, Homo sapiens
tgacagagcgagattccgtctccaataaaaagaaaaacaaaagtatttataggactctctaatgtctctgtttaacttattcagagacaatatcagaggaagttactgtactgatattttaagagggtgaatggataatgtaactgaatttcaagggtactgagacaggcattttggttgtttctttggagcagtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303147 - DNA, 6458 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcccctacccccccaagaggtctggtcttgacagcaccctgcccacacagagtggctgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303148 - DNA, 7199 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggtaatcgcccctggtcaaatgatgatgctatggcatcaatcctccaaaggaagaggaacccgggttgccgcatggtttaagtaggggagctatagtaacacttagtgccctttatatcaatgtgggtttattgtgttcatacatttctttctgttttacaaagtcaaaaacatcctttgctggttttgcaccagagaataggggttagttatcatctgtgtttaccatgtggcctcacatgagttaacagtttaaagcactagagattgttatagagagttttaagctaccagaataaaacagattgattttttctcagagcttgagtacagctgaatattgcctctatcttaaaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303149 - DNA, 5797 bp, Homo sapiens
attaccataactccttaaataaataatagattaccataactccaaatggagagaaagtatggtttttttctctcttacggaaagttcatggtctttatgaaaaatccaaccagaagccttttcacacaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggtaatcgcccctggtcaaatgatgatgctatggcatcaatcctccaaaggaagaggaacccgggttgccgcatggtttaagtaggggagctatagtaacacttagtgccctttatatcaatgtgggtttattgtgttcatacatttctttctgttttacaaagtcaaaaacatcctttgctggttttgcaccagagaataggggttagttatcatctgtgtttaccatgtggcctcacatgagttaacagtttaaagcactagagattgttatagagagttttaagctaccagaataaaacagattgattttttctcagagcttgagtacagctgaatattgcctctatcttaaaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303150 - DNA, 6900 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagaacatatcctcccctgagagttcccctgcgcataggcccgagtccctgtcacccgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303151 - DNA, 6781 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303152 - DNA, 7169 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccaggtgagatgagaaattgctggtctctagccataggagtgtgttctgggtcccaaattgtcctggtcatcctttgccattgagatgctgtctttgcatatagtttcagcagccttggaaataagtcatcatctgcttgtcctcaggtaataaattatgccagaagatgaatacggtgatcaaagacagacattttactgcctttggtttcctaaaaagaatacatggttaaaagatgaagaaaaaagaatgtagggtattataaatgttcaccagccatttaagggacttgttcgcgtccttattcgtttcctcccaactttgtctagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303153 - DNA, 3104 bp, Homo sapiens
  misc_feature (83)..(83): n is a, c, g, or t
agcacaggaactctgagttccacctcctttcctcagaactctaggtcgtcattgccatcagacttacggactatcagtctgcncagtgccgagcagatacagctaccaggtgagatgagaaattgctggtctctagccataggagtgtgttctgggtcccaaattgtcctggtcatcctttgccattgagatgctgtctttgcatatagtttcagcagccttggaaataagtcatcatctgcttgtcctcaggtaataaattatgccagaagatgaatacggtgatcaaagacagacattttactgcctttggtttcctaaaaagaatacatggttaaaagatgaagaaaaaagaatgtagggtattataaatgttcaccagccatttaagggacttgttcgcgtccttattcgtttcctcccaactttgtctagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303154 - DNA, 2778 bp, Homo sapiens
  misc_feature (83)..(83): n is a, c, g, or t
agcacaggaactctgagttccacctcctttcctcagaactctaggtcgtcattgccatcagacttacggactatcagtctgcncagtgccgagcagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303155 - DNA, 4806 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagatttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgaga

SEQ ID NO: 303156 - DNA, 4822 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagacttacttggtcctttccagtggctttggaaccaggccggcattttggtgggaacggggg

SEQ ID NO: 303157 - DNA, 3265 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgaggtgatttgggtttggttgctgggagtgctggatatgaaaatcatcatttgtaccttctcatttcaaatataataccattccaaaaaa

SEQ ID NO: 303158 - DNA, 3378 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagatctggattcaggctgccttcctcagtgtctgccattgccctcctccactggcatcacgtacatgaggatgctgcatgtagattatttgatgtgatgaagtctccaactccagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgaggtgatttgggtttggttgctgggagtgctggatatgaaaatcatcatttgtaccttctcatttcaaatataataccattccaaaaaa

SEQ ID NO: 303159 - DNA, 1615 bp, Homo sapiens
gcggccgccgcccgcctgcgctcatagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcaggtaagcaccaaagggttgaggactctctaagtagctgaaattttaagaacccaggaagagggtaatggattggaattactgttccttccaaatgtacaaggccatggaataacagattagccaggtgttgatcatatgtaaccaaaagtaggttatattaactggaaactacctggatacatatttttaaactacctttattaataaaaaaatagatgaattgaggctgtgtgcagtgcagtggctcactcctataatacaacactttggcaagaagccaaggtggaaggattgcttgaggccagcagttcaagaccagcctgtacaacatagtgagaccctctctttaca

SEQ ID NO: 303160 - DNA, 616 bp, Homo sapiens
ctgatgtctcttctgagaacccttgaggttcctgagtgagagcacacagcagtggatgactgggtagagacggatatgttttgtgtgtgctcttgtgatatgggttaacatgtccatttatgattattgtgtgagattaggccctgggtcctctagaacactgttgcataaatgaaaaaaattaaattgttttgaatcaattcaaccgttattatccactatcatcacttgaaggaaattagaggaaaaatcctattgtaattggcataattcctgttccttgatcaaatgacaagtcggactgtttattccaagagaatacagaatctaccctaaaagactctctttccctctctgtttctgcctctttctcctctttccagttacttactgtttttggatctagtggcagtagcgtttggtggtgtttttggaatgctctttcttaattcccagaagccctgcatattttccaaaggtgtctcttaggaatagatcactccctcagatctatgatgtcgttttccatgtttctagaagtataggacaccctttcatttggtcttcctttgaggtagagtctgttccctggaacacccttttctcttatcctcag

SEQ ID NO: 303161 - DNA, 432 bp, Homo sapiens
tgtgaatacccggaggtcttcccaagcaggggtaagagttgaaaagacttcagcacttagacatcctcacctttgctaatgtcaatacctaacttttggaatttttaaaatcagtgttttcagctttgctccatatcacaataaataaggccattaactgtttaactggaaccatttcattggcctattttataaatgcttattagaaataacgcaaacatttgtcgctagcctctttagctcatttaagtgtatacatttttgtatttaaaaattagattttaaattagtgtttctaatccttatatttttcatcagtagacattctgaatgcttaaagtgaataggaaattagactgtttgctgataaaacatttctggtaagcatctgaccctactattgctacaggatattgctgcagaaaaactagt

SEQ ID NO: 303162 - DNA, 641 bp, Homo sapiens
tgttcagtattttatctgaaatttaataatggatattgtacagcctaaggaattaaaagaaaaaggaccctttgagaaaatggcttgttcttatgtatcttaatatatactgtgttcactttatgttttgtcagacactgaaattgaggaagagagattttggcgttctgttggtttatggagagagttgatcagagattgctccttggctgagttgctgtctgcataggctgttaacaattgtttctctggcagcagatcttgttcatcaggattgcatcatttctgggagaatggccaaggtccacagcctcaatacaaagactgtctgaagcatatgaggcctgttctctttctgaagcggcactcctcttcctgccagtcctcttcacaggattactgaagcagacttgttctgaatttctttcgttggattggttgtttattggacttttgtctgccagctgcttccgcctcacctgtctgatgcaatttcttcttctgaaatctgttggaattgttcataaaacactttttgtttgtcttctctgtgagtgaccagggagatcatacaggtcttgtgctttcagcaagtcatatagagaagagactgtcagaatgatgatacagagactgttggc

SEQ ID NO: 303163 - DNA, 590 bp, Homo sapiens
gcctcaatacaaagactgtctgaagcatatgaggcctgttctctttctgaagcggcactcctcttcctgccagtcctcttcacaggattactgaagcagacttgttctgaatttctttcgttggattggttgtttattggacttttgtctgccagctgcttccgcctcacctgtctgatgcaatttcttcttctgaaatctgttggaattgttcataaaacactttttgtttgtcttctctgtgagtgaccagggagatcatacaggtcttgtgctttcagcaagtcatatagagaagagactgtcagaatgatgatacagagactgttggccatttctgaaaccaattaaaaagatggggtaattaagaaacatttctggcatgttctatttaacatccttttccctagaaactgtatgtaaatggcacctcctaaagagagtactcggtactactggaagatacaggctgtgtctgtttctgaatccaagaacttactagtgttcctgtggattctgatggattgttctggaaatagttaaattaataataaattgaaactgtgatgcattcatttaccccctactgt

SEQ ID NO: 303164 - DNA, 351 bp, Homo sapiens
actaaccctaatcgcccatatgtaccatactttaggggagagaggggccagtgtttggacactgttgatttaaaaaatcttattttcaggatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggtaagatcctgttccatctaaattaagtctgggttgctgggattagggtttct

SEQ ID NO: 303165 - DNA, 556 bp, Homo sapiens
aatggtgacacctcctttccaagccaagcattccttgctttgtgcttgttctttaatcaaaagcagacaaacgtgatgctttcccaagtttaggcgttgcaaaagactgctgctgcttctctcagcatatgcttcatatttggagtcatggggtggccttcttatttgtgttgagaattacaggaattttaattgtatccctagaccatacccctttgtgctcttctactcaaaattcaatggtgtagagatgtgtgtggatgcccgtactttcggtaatgatgctcggttcatcagaagatcatgtacaccaaatgcagaggtaagatatctgtagcaacttccctttgactggaaccatcaaatgacaagcttactgaagaagcagtgtgaaaacttcactcagataaaggtctgtagataatagtcgtgatatttcatcgtgggaggtgaaaaacaaaagtaatggtgcttttatacgacaaaatgggcgcaaggaaagagttttctttagagaaggcagaaatagaaaagagcaagttagcatttgctaagg

SEQ ID NO: 303166 - DNA, 469 bp, Homo sapiens
tcaaatgtttcatgttcattaatctatgaaacctttattaaaccagtactgtgtatcaggcacatgatttcctaaaggagaaattttaacattttaaatgggggttaagggaagttaacatctttaacccactttttccttgatttctttttctttaaaagtggttgttgttgatgtttctcttttgtgcctgacatagttggaggcagaggaaatacgttgttttaaattggttctgaagaaagtaatgtttaagaggatgttttaagaaaatacactgtgcactggttagggcttcatttgttttggttaagtcctgtggcttgaacttgcaccctgttgcctttacaggatggttcccacatcagtagaacgactccgagaaggagggagcatccccaaggtcctccgaagcagcgtgagggtggcccaaaagggagagccctctcccacatgggagagtaacatc

SEQ ID NO: 303167 - DNA, 461 bp, Homo sapiens
tcttattcaacttccccgcccccgaaaaaagttatggctaacatctatgcttgcttttattttttgttttgttttgcttcttgacttcgagtagatgaataataacaagatgcttttccctcctctagaacatatcctcccctgagagttcccctgcgcataggcccgagtccctgtcacccgaggtagttatcacaccatctcaatcacacttggaggctgagagtgagtgttcatgaatgtgttcctgagtgtgtggggagggctggggatctgagtcagtggggtgatgggctggagggcggccactcagtcacagtaagttgaatgagtcttcctgtgtgactgtgactacacaggactgtcaatgtagatggaggaaaatgaaggtaggagcgtgtgtgtttgtgtgtgtgtgtgttgtgtgtgtgtttggtggggttggtttttgccgtttgggg

SEQ ID NO: 303168 - DNA, 405 bp, Homo sapiens
atgtacatttaaaacaggtgcactaaatagttttaggtaattattgataattctctggttcttttcaattatagcgctggataaaacaagccttagaagaagggatgactcaaacatcatctgtaccccaagagactagaactcagcacctataccaaagcaatgagaatagtagctcttctagtatctgcaaagacaatgcaggtacgtatctaaaacctttctgattatatgaccaatgattgtttcaggtctgcataaaaaatttaagtatgagtatttctgatacaaaaagaaatggcgtgttttctaaatagttactttacatctgtctttacagaggaagagagagatctcaagtcagggatcagttttcccaggacgacaaagaaggactagacagtg

SEQ ID NO: 303169 - DNA, 532 bp, Homo sapiens
tgaagagaaagaagacgggaatcacatcaggcatttagaacatagcccataattaaccactcattttgcccttctggcatgctgcactcacccaatttgtcacaaagagagcagtacgggttggtgatggcactggtgatttaaatgaaaaatggctctttcttacttattctaagaagccaagttgatttttttttatatatgttaccttccagaccctgcagatggagaaggcccagagacattaagctcagcactctctaaaggagcaacagtttacagcccttccagatacagctaccaggtgagatgagaaattgctggtctctagccataggagtgtgttctgggtcccaaattgtcctggtcatcctttgccattgagatgctgtctttgcatatagtttcagcagccttggaaataagtcatcatctgcttgtcctcaggtaataaattatgccagaagatgaatacggtgatcaaagacagacattttactgcctttggtttcctaaaaagaatacatggtta

SEQ ID NO: 303170 - DNA, 431 bp, Homo sapiens
ttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggcatttgacatgtg

SEQ ID NO: 303171 - DNA, 3368 bp, Homo sapiens
tgcgtcatcacgtcgcgcggccgcaggggccagacccggacggctccagagcctccagagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactacgtgcaccgggtgattacaggcaccagtgcagtgatgattgtacttatttgacacatactccccgtcgtcctggttcttgttcctgagaagggtgggtaagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtcttttttttttttttcccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgccgagagtttgtggctaaaaaaaa

SEQ ID NO: 303172 - DNA, 2279 bp, Homo sapiens
tccccagtgcctaactctgctgtctgctatatttcagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctgatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactacgtgcaccgggtgattacaggcaccagtgcagtgatgattgtacttatttgacacatactccccgtcgtcctggttcttgttcctgagaagggtgggtaagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtcttttttttttttttcccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgccgagagtttgtggctaaaaaaaa

SEQ ID NO: 303173 - DNA, 3169 bp, Homo sapiens
tgcgtcatcacgtcgcgcggccgcaggggccagacccggacggctccagagcctccagagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactacgtgcaccgggtgattacaggcaccagtgcagtgatgattgtacttatttgacacatactccccgtcgtcctggttcttgttcctgagaagggtgggtaagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtcttttttttttttttcccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacattcttcagcacggggtaccgagctagaag

SEQ ID NO: 303174 - DNA, 3320 bp, Homo sapiens
tgcgtcatcacgtcgcgcggccgcaggggccagacccggacggctccagagcctccagagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactacgtgcaccgggtgattacaggcaccagtgcagtgatgattgtacttatttgacacatactccccgtcgtcctggttcttgttcctgagaagggtgggtaagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtcttttttttttttttcccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatacaactcagggaaagaaaaaaaaaa

SEQ ID NO: 303175 - DNA, 3089 bp, Homo sapiens
tgcgtcatcacgtcgcgcggccgcaggggccagacccggacggctccagagcctccagagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactacgtgcaccgggtgattacaggcaccagtgcagtgatgattgtacttatttgacacatactccccgtcgtcctggttcttgttcctgagaagggtgggtaagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtcttttttttttttttcccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtctttttccgccgaaagaaggtcctccctaccctcgcccgttggggtatattctttctcctcgcgcggac

SEQ ID NO: 303176 - DNA, 3065 bp, Homo sapiens
tgcgtcatcacgtcgcgcggccgcaggggccagacccggacggctccagagcctccagagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactacgtgcaccgggtgattacaggcaccagtgcagtgatgattgtacttatttgacacatactccccgtcgtcctggttcttgttcctgagaagggtgggtaagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtcttttttttttttttcccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgccgagagtttgtggctaaaaaaaa

SEQ ID NO: 303177 - DNA, 3400 bp, Homo sapiens
atgcagagtatatactgaggtctgtggatcctaaggctcagaggattctcgccgcagcgttgttcggcccgaaaaggccattgtggacaatggacgtgaataaatttgaggcctctgtgggttttctcgatgtcaaaaagttcctcagtacctggaagaaacggggttttgccgtgatccccaggcgggtctggaactccggagctcagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactacgtgcaccgggtgattacaggcaccagtgcagtgatgattgtacttatttgacacatactccccgtcgtcctggttcttgttcctgagaagggtgggtaagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtcttttttttttttttcccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgccgagagtttgtggctaaaaaaaa

SEQ ID NO: 303178 - DNA, 2536 bp, Homo sapiens
tgcgtcatcacgtcgcgcggccgcaggggccagacccggacggctccagagcctccagagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactacgtgcaccgggtgattacaggcaccagtgcagtgatgattgtacttatttgacacatactccccgtcgtcctggttcttgttcctgagaagggtgggtaagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtcttttttttttttttcccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgccgagagtttgtggctaaaaaaaa

SEQ ID NO: 303179 - DNA, 966 bp, Homo sapiens
tgcgtcatcacgtcgcgcggccgcaggggccagacccggacggctccagagcctccagagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggatctggcactgtggttcctgcatgaagacagtggctgcggtgcctggacgtacaataccacttccgctgtcacggtaaagtccgccatcagaagactgaaggagttgaaagaccagtagacgctcctctactctttgagacatcactggcctataataaatgggttaatttatgta

SEQ ID NO: 303180 - DNA, 318 bp, Homo sapiens
catggttactaccagcaatactcctggaatcacagggctttgcaaactggttttctgtagtcagaagttaattatttgcatgtgctctttgtactcttatagtattacaggtatccccagtgcctaactctgctgtctgctatatttcagcctttcatccgctgtagtttacaatgcagggatctggttgatgaagcaaagaagtttcatctgaggcctgaacttcggagtcagatgcagggacccaggacaagggctcgcctaggtaagctggtatctcggcagaatgaggggatgcttttcaactacttcttgcag

SEQ ID NO: 303181 - DNA, 2384 bp, Homo sapiens
ccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccctgcgcctgcaccgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaa

SEQ ID NO: 303182 - DNA, 2342 bp, Homo sapiens
ccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaa

SEQ ID NO: 303183 - DNA, 360 bp, Homo sapiens
cagagtagcaacatggggagcattggttgactttgaggagtcaggcagcaagacttcagggtttatgaagtgtaatattttgagaaagtgagtgtatttaatcttgtcatgttacaaatattgaaatctcagcagacttcagttctttatttgatatacatcagggctttctcattaagagtatttttctgaaattgtcagttataggaagaaagttattcttccagcaggtttataatatcttgattattaaatttaaattgttttagtggaaggaggcaaaaccggaagaccttatggattcagtaagtatatttatagttaacaataattgaatgttgtaagctgatacttatttgc

SEQ ID NO: 303184 - DNA, 4602 bp, Homo sapiens
  misc_feature (4506)..(4506): n is a, c, g, or t
  misc_feature (4600)..(4600): n is a, c, g, or t
ccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccctgcgcctgcaccgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctgtggttactggctccacagcacctcagagagggcggccctggcttcagaaatgccagccatagtgctcacaaatgcagaagagatggaagcggtgacagaatcctgaaagtttttattgattgaagttttaaattggtaacttaagcttccttggcacgatacaaaatacctcttaaagacagcaggcttttttatttgtaggtgtgaggaactggctttaacttttttctcctcctagtttgcatgttttccttctctcgtcttctgaactgctggcaccagcagtaatacatactgataaaatcaaaattgatttttaccagtggccagtttatggctagagagacgacttatacctccataacacagaagggggaaaaatgaagaacctccagtgatccgtgaaaacctaaacgctttcaaacaaatcccaggaacagaattgctatcgaaagatatcattgcccagtttgcaggctatgttgagtcagatagaactgaatgtagtgagagctcagagctacagagcctttcagatgaatttgaaaacagactctgtgtgtgtgtgcatatgccnaggggaaggaaataacattgcactttataaacactgtattgtaagtggaaaatgcaatgtcttaaataaaactatttaaaattggcaccataanaa

SEQ ID NO: 303185 - DNA, 4303 bp, Homo sapiens
  misc_feature (4207)..(4207): n is a, c, g, or t
  misc_feature (4301)..(4301): n is a, c, g, or t
cgacgccacccgcccgcgccgtcgccccgacggaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctgtggttactggctccacagcacctcagagagggcggccctggcttcagaaatgccagccatagtgctcacaaatgcagaagagatggaagcggtgacagaatcctgaaagtttttattgattgaagttttaaattggtaacttaagcttccttggcacgatacaaaatacctcttaaagacagcaggcttttttatttgtaggtgtgaggaactggctttaacttttttctcctcctagtttgcatgttttccttctctcgtcttctgaactgctggcaccagcagtaatacatactgataaaatcaaaattgatttttaccagtggccagtttatggctagagagacgacttatacctccataacacagaagggggaaaaatgaagaacctccagtgatccgtgaaaacctaaacgctttcaaacaaatcccaggaacagaattgctatcgaaagatatcattgcccagtttgcaggctatgttgagtcagatagaactgaatgtagtgagagctcagagctacagagcctttcagatgaatttgaaaacagactctgtgtgtgtgtgcatatgccnaggggaaggaaataacattgcactttataaacactgtattgtaagtggaaaatgcaatgtcttaaataaaactatttaaaattggcaccataanaa

SEQ ID NO: 303186 - DNA, 4560 bp, Homo sapiens
  misc_feature (4464)..(4464): n is a, c, g, or t
  misc_feature (4558)..(4558): n is a, c, g, or t
ccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctgtggttactggctccacagcacctcagagagggcggccctggcttcagaaatgccagccatagtgctcacaaatgcagaagagatggaagcggtgacagaatcctgaaagtttttattgattgaagttttaaattggtaacttaagcttccttggcacgatacaaaatacctcttaaagacagcaggcttttttatttgtaggtgtgaggaactggctttaacttttttctcctcctagtttgcatgttttccttctctcgtcttctgaactgctggcaccagcagtaatacatactgataaaatcaaaattgatttttaccagtggccagtttatggctagagagacgacttatacctccataacacagaagggggaaaaatgaagaacctccagtgatccgtgaaaacctaaacgctttcaaacaaatcccaggaacagaattgctatcgaaagatatcattgcccagtttgcaggctatgttgagtcagatagaactgaatgtagtgagagctcagagctacagagcctttcagatgaatttgaaaacagactctgtgtgtgtgtgcatatgccnaggggaaggaaataacattgcactttataaacactgtattgtaagtggaaaatgcaatgtcttaaataaaactatttaaaattggcaccataanaa

SEQ ID NO: 303187 - DNA, 4240 bp, Homo sapiens
  misc_feature (4144)..(4144): n is a, c, g, or t
  misc_feature (4238)..(4238): n is a, c, g, or t
ccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccctgcgcctgcaccgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctgtggttactggctccacagcacctcagagagggcggccctggcttcagaaatgccagccatagtgctcacaaatgcagaagagatggaagcggtgacagaatcctgaaagtttttattgattgaagttttaaattggtaacttaagcttccttggcacgatacaaaatacctcttaaagacagcaggcttttttatttgtaggtgtgaggaactggctttaacttttttctcctcctagtttgcatgttttccttctctcgtcttctgaactgctggcaccagcagtaatacatactgataaaatcaaaattgatttttaccagtggccagtttatggctagagagacgacttatacctccataacacagaagggggaaaaatgaagaacctccagtgatccgtgaaaacctaaacgctttcaaacaaatcccaggaacagaattgctatcgaaagatatcattgcccagtttgcaggctatgttgagtcagatagaactgaatgtagtgagagctcagagctacagagcctttcagatgaatttgaaaacagactctgtgtgtgtgtgcatatgccnaggggaaggaaataacattgcactttataaacactgtattgtaagtggaaaatgcaatgtcttaaataaaactatttaaaattggcaccataanaa

SEQ ID NO: 303188 - DNA, 4148 bp, Homo sapiens
  misc_feature (394)..(394): n is a, c, g, or t
  misc_feature (4052)..(4052): n is a, c, g, or t
  misc_feature (4146)..(4146): n is a, c, g, or t
ccgatgaggaaaatggtgacttgtgatggcactcaaagcagtatggcccggtaccctaggcaggctgcccaggccgatactcaccctccaggagcatattgaggccattcctagcgacagggccgagaaggcctggtgccagcatggatgactactaaagagaagatgtggtcccagcatgcccaatgaaatcctctcaacagccatcgctcatccatcattcagtcacaacactaactatccccagctcgggcttccacgcacatcaacattcagatgtccctcggtactcacctccaatcatatgctcactcttctcaggttctgtaacatacgagattgttcatcacggcgaatgtacgcgccagtcaaatgctcccgagcgcctcgccanatggtcgatactgttgaggtccgggcatggccacgcgaggcatcagtgatcgaccgcatgccatgcatcgtcgatgcgcccaaaatcgacgatggtgcccactgcactcccatcgggttcacctccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctgtggttactggctccacagcacctcagagagggcggccctggcttcagaaatgccagccatagtgctcacaaatgcagaagagatggaagcggtgacagaatcctgaaagtttttattgattgaagttttaaattggtaacttaagcttccttggcacgatacaaaatacctcttaaagacagcaggcttttttatttgtaggtgtgaggaactggctttaacttttttctcctcctagtttgcatgttttccttctctcgtcttctgaactgctggcaccagcagtaatacatactgataaaatcaaaattgatttttaccagtggccagtttatggctagagagacgacttatacctccataacacagaagggggaaaaatgaagaacctccagtgatccgtgaaaacctaaacgctttcaaacaaatcccaggaacagaattgctatcgaaagatatcattgcccagtttgcaggctatgttgagtcagatagaactgaatgtagtgagagctcagagctacagagcctttcagatgaatttgaaaacagactctgtgtgtgtgtgcatatgccnaggggaaggaaataacattgcactttataaacactgtattgtaagtggaaaatgcaatgtcttaaataaaactatttaaaattggcaccataanaa

SEQ ID NO: 303189 - DNA, 2696 bp, Homo sapiens
cgacgccacccgcccgcgccgtcgccccgacggaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaaaaaaaaaaaaaaaaaaaaaaaaaaaaaaaaaaaaaaaaaaaaaaaaaaaaaaaagaaaaaaaaaaaaaaaaaaaaagagaaaaagaaaagacacgaagcgcacaagccaagcgagcgaaaaaaagaaacaaatccgagaaaagcaagcgaacatgcaagcaaagagtagcaagcacagcacggacaaaaaaacggacacgcacacgacggccaggggcgctacaaagacacaaagccggggaacgaagaaaaaaacaagagaaaaagagcagagagaagaagcacaccaagtgacgaggaacaaagaacacagggacacaggaaacacaagggagcagaagccaagaggaccaaaggataactgcgaacaacgacgcgcacgcgggagcagactggagggcagcgagccgcaacacagcgcgaggacgacagagacaacataaggggcgggaaggatagagacaacaaacaggctggagcggggagggcagcgggaagaaaaaaaacgcggaggagagaggagggggcgcggagcaagagccgcgcgaagggggagggagtgggaacagaagacgcggcgaggagcgcccgaccgagcgaacgtaaaggga

SEQ ID NO: 303190 - DNA, 2022 bp, Homo sapiens
ccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccctgcgcctgcaccgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaa

SEQ ID NO: 303191 - DNA, 3447 bp, Homo sapiens
  misc_feature (47)..(47): n is a, c, g, or t
  misc_feature (57)..(57): n is a, c, g, or t
  misc_feature (70)..(70): n is a, c, g, or t
  misc_feature (72)..(72): n is a, c, g, or t
  misc_feature (3351)..(3351): n is a, c, g, or t
  misc_feature (3445)..(3445): n is a, c, g, or t
gttcaatggacagggaaggcaaaaggacaagagaaaaaatgaatcanatagccacanccagacacaatantnaacaacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctgtggttactggctccacagcacctcagagagggcggccctggcttcagaaatgccagccatagtgctcacaaatgcagaagagatggaagcggtgacagaatcctgaaagtttttattgattgaagttttaaattggtaacttaagcttccttggcacgatacaaaatacctcttaaagacagcaggcttttttatttgtaggtgtgaggaactggctttaacttttttctcctcctagtttgcatgttttccttctctcgtcttctgaactgctggcaccagcagtaatacatactgataaaatcaaaattgatttttaccagtggccagtttatggctagagagacgacttatacctccataacacagaagggggaaaaatgaagaacctccagtgatccgtgaaaacctaaacgctttcaaacaaatcccaggaacagaattgctatcgaaagatatcattgcccagtttgcaggctatgttgagtcagatagaactgaatgtagtgagagctcagagctacagagcctttcagatgaatttgaaaacagactctgtgtgtgtgtgcatatgccnaggggaaggaaataacattgcactttataaacactgtattgtaagtggaaaatgcaatgtcttaaataaaactatttaaaattggcaccataanaa

SEQ ID NO: 303192 - DNA, 2793 bp, Homo sapiens
  misc_feature (2697)..(2697): n is a, c, g, or t
  misc_feature (2791)..(2791): n is a, c, g, or t
ccgcatcatcaacacggagcagtacatgcactcacttcgtgggcagcgctgcccacgaagtggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctgtggttactggctccacagcacctcagagagggcggccctggcttcagaaatgccagccatagtgctcacaaatgcagaagagatggaagcggtgacagaatcctgaaagtttttattgattgaagttttaaattggtaacttaagcttccttggcacgatacaaaatacctcttaaagacagcaggcttttttatttgtaggtgtgaggaactggctttaacttttttctcctcctagtttgcatgttttccttctctcgtcttctgaactgctggcaccagcagtaatacatactgataaaatcaaaattgatttttaccagtggccagtttatggctagagagacgacttatacctccataacacagaagggggaaaaatgaagaacctccagtgatccgtgaaaacctaaacgctttcaaacaaatcccaggaacagaattgctatcgaaagatatcattgcccagtttgcaggctatgttgagtcagatagaactgaatgtagtgagagctcagagctacagagcctttcagatgaatttgaaaacagactctgtgtgtgtgtgcatatgccnaggggaaggaaataacattgcactttataaacactgtattgtaagtggaaaatgcaatgtcttaaataaaactatttaaaattggcaccataanaa

SEQ ID NO: 303193 - DNA, 1503 bp, Homo sapiens
ccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccctgcgcctgcaccgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccacatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaa

SEQ ID NO: 303194 - DNA, 1503 bp, Homo sapiens
ccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccctgcgcctgcaccgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctgtgatgttacagcctttcgattatgatcccaatgagaaaagtaaacacaagtttatggttcagtctatgtttgctccaactgacacttcagatatggaagcagtatggaaggaggcaaaaccggaagaccttatggattcaaaacttagatgtgtgtttgaattgccagcagagaatgataaaccaactagtgaccgggcggggggtggaggaagaggcctcgcgcagaggagggagcaattgaatttcaaacacaaacaactgcacgagcgcgcacccaccgcgccggagccttgccccgatccgcgcccgccccgtccgtgcggcgcgcgggcggagacgccgtggccgcgccggagctcgggccgggggccaccatcgaggcgggggccgcgcgagggccggagcggagcggcgccgcaccgccgacgcgcaaacttgggctcgcgcttcccggcccggcgcggagcccggggcgcccggagccccgccatgtcgcgatccaaccgggcagaaggagtacaaatgcggggacctggtgttcgccaagatgaagggctacccacactggccggccggattgacgagatgcctgaggctgcgtgaaatcaacagccaagaaatacaagtcttgttgtcgggaccacgagacggcatccctgggcccagagaactcttcccttacggggatccaggagaagtgggaagccacaagagaaggttcagcgagggtgtggacatcgagaaaactcctgaagagtcggcataagctccgaaagatggtgacacctgacaaacgaagtgcaggagcgaaacaggacgaaggcaagagagaagcagggcagaggcgcgaaaacacaggcacgaaggaacggagcaatcaaggaactgaagaggacacgacgcaggaacacgtacacagaacgagaaggcacacaagcaggggaacagtaaa

SEQ ID NO: 303195 - DNA, 2465 bp, Homo sapiens
actttcctttcccctttcataaaagcacagacctaacagcaccctgggtggaaacctcttcagcatttgcttggaatcagtaagctaaaaacaaaatcaaccgggaccccagcttttcagaactgcagggaaacagccatcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttaaaaaaaaaaat

SEQ ID NO: 303196 - DNA, 2504 bp, Homo sapiens
cttccttcccctaaaagcaattactcaaaaacggagaaaacatcagctgatgcgtgccctactctcccacccctttatatagttccttcagtatttacttgaggcagacaggaagacttctgaagaacaaatcagcctggtcaccagcttttcggaacagcagagacacagagggcagtcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttaaaaaaaaaaat

SEQ ID NO: 303197 - DNA, 2622 bp, Homo sapiens
cttccttcccctaaaagcaattactcaaaaacggagaaaacatcagctgatgcgtgccctactctcccacccctttatatagttccttcagtatttacttgaggcagacaggaagacttctgaagaacaaatcagcctggtcaccagcttttcggaacagcagagacacagagggcagtcatgagggtcccactctatcaccctggctggagtgtaatggtgtgatctcagctcactacaacttttgcctcctgggctcaagtgatcctcctgtctcagcctcccgaatggcgaggactacagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttaaaaaaaaaaat

SEQ ID NO: 303198 - DNA, 2205 bp, Homo sapiens
actttcctttcccctttcataaaagcacagacctaacagcaccctgggtggaaacctcttcagcatttgcttggaatcaaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttaaaaaaaaaaat

SEQ ID NO: 303199 - DNA, 2434 bp, Homo sapiens
actttcctttcccctttcataaaagcacagacctaacagcaccctgggtggaaacctcttcagcatttgcttggaatcagtaagctaaaaacaaaatcaaccgggaccccagcttttcagaactgcagggaaacagccatcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctcttctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttaaaaaaaaaaat

SEQ ID NO: 303200 - DNA, 2437 bp, Homo sapiens
cttccttcccctaaaagcaattactcaaaaacggagaaaacatcagctgatgcgtgccctactctcccacccctttatatagttccttcagtatttacttgaggcagacaggaagacttctgaagaacaaatcagcctggtcaccagcttttcggaacagcagagacacagagggcagtcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttaaaaaaaaaaat

SEQ ID NO: 303201 - DNA, 1948 bp, Homo sapiens
actttcctttcccctttcataaaagcacagacctaacagcaccctgggtggaaacctcttcagcatttgcttggaatcagtaagctaaaaacaaaatcaaccgggaccccagcttttcagaactgcagggaaacagccatcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaaaaaaaactttcgaactatggttctacccagctagggacatccactttcatgtgc

SEQ ID NO: 303202 - DNA, 1291 bp, Homo sapiens
  misc_feature (1)..(1): n is a, c, g, or t
nagaatgggtaggccttgtaaaattgacagagaggggaaaccccgtaaagtggtatagtggtggtatagcctgataccatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttaaaaaaaaaaat

SEQ ID NO: 303203 - DNA, 1317 bp, Homo sapiens
tagggcagggagaccagttagggacctgctgcggtggaccaggtgagatgatgctggtctgggcgagaatgtcaggaatggaggtgaggagaagaggtcctattatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttaaaaaaaaaaat

SEQ ID NO: 303204 - DNA, 530 bp, Homo sapiens
cccccctttgaaactttagccaaaaaaaagcgtttacctttaaaaaaaaaggttgcaaaaaaccaaaattggccccctccccccaaacttggggacaaaagaaaaatcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttaaaaaaaaaaat

SEQ ID NO: 303205 - DNA, 3108 bp, Homo sapiens
ttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303206 - DNA, 906 bp, Homo sapiens
gcagagtggttacatgggtgtaagcacaggtaaaaattcactgagctgtacacttaagatttgtgcattttactgtatatacattatatctcaaaataaaactagaaatataagaaaaagccaaccacgacggactgaaaacaaacatacaaatttggacgtgcgatgatcttttagtcattatggtttcagatttgctgttagttactgattgatatttaatcaaagtgacgtgaaacactttttcccctcttgagctgatcgttcagtaagctaagttacttaaaaggatcttgtgatctttttataagaccagaaagcctttaatttacctgttattaagtaagatggagtagtaacggtttccaaaatttgtataacacacgatgaagtctctagggggcagggtaaacacagattttttttttcacttcatccttctctgcggcgatgtctttatggagttcgtcaggcaacggtatcagatagcaaatgggtttttaactaatctttccctaaggtactgtagttctatattctatcctatagattctcaaaatccacttttacactaggatgccactggagggcagttctgatttggatatatcttaaaaatgatttgcttttatgttttcatctccctgcgttataaagcaccatcctctgaatttggtcgttgcatcgggtcaaaagttctgcagcttgaaaaaccctgcaaaaacatccggaaaggagggagaacactacaactcccagaacgcaatgctttccctctcgccagcctgtcccctccagctgctcaatgaccagcctctgtgagcctcctctcagccctattggtcagtttgctcgtcagtgagtgaggcggagggaggggaggaacagagaatcccggatggtacg

SEQ ID NO: 303207 - DNA, 3130 bp, Homo sapiens
ttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacaaaaaaaggggggcccggtaaac

SEQ ID NO: 303208 - DNA, 3259 bp, Homo sapiens
ttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccagagacgggatctcaccatgttgcccaggctggtcttggactcctggcctcaagcagtccttctacctgagcctcccaaaaggctgggattacaggcataagccactgtgcttgtttgatctcattctttttaatgactgcagggtttccatggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303209 - DNA, 3057 bp, Homo sapiens
ttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303210 - DNA, 2873 bp, Homo sapiens
ttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaagcccccaaaagtactcagaagtcatatgttatttacgtcg

SEQ ID NO: 303211 - DNA, 2896 bp, Homo sapiens
  misc_feature (2896)..(2896): n is a, c, g, or t
ttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaagcatactgcaataatatatagtttctcgctgcgtggtgtgttgcggggtgtgtgtgggggggn

SEQ ID NO: 303212 - DNA, 2977 bp, Homo sapiens
ttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303213 - DNA, 2935 bp, Homo sapiens
ttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttagtgggaagtcgacttcccaccgggacccgggaggcaaaagttccaatgagctgagatagcgccagtgcactctagcctgggtgacagagtgagactctatctcaatcaatcaatcaatcaatcaatcaaagttccagctacttgagaggctgaagcaagaggattgcttgagctcaggagttcaagaccagactaggcaagacagcaaggctttaaaaaataaaaaatgaagaaagaaataaaataaatgttggcaaggatgtaaagaaattggagccttcacacactcccggtgggaagt

SEQ ID NO: 303214 - DNA, 2591 bp, Homo sapiens
gtacttggctttttttgttactgaataataaaattttatgaagtcatcttatttgccatgacaggtgagtgtggcatttttaagacaggacggagatcactctgtccctctgtgtgcctttttctaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303215 - DNA, 2333 bp, Homo sapiens
cctgaggggtgccgagcgccccgcaggttttttaaactgtcaggctcggaggggtggggcactacgttgctcctgaaataagggaggctacagctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303216 - DNA, 2319 bp, Homo sapiens
ccaccgagtgtcgacacctgtatcattgtgggggggcaaactacacggtgcctcttctgtgaaagaaaggaagcttccccttttggaaccttaagactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303217 - DNA, 2121 bp, Homo sapiens
ttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcactgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303218 - DNA, 2127 bp, Homo sapiens
caggtgtgagtggatgtgcctggccagtttctaagatgttatgatatatagatcattgaccattttagttgaggttttacttgtatcttctgagtaagggactccaaaaagttctaagtgcttgtagcctaaccaacttgccctgtctttatgacaggtaggggaaagggatcatctttcagagtcaggtcctgccttgggaatgagaagagcagaataaggtttgggaagcaggggcctggttttcagacctacactcagcctgttagaggttcctgtagtagaaagtggggcttcctaggaagctcagttaaagaagggttgcaggtagaagagatgatttacattgtttaatggctttaaaacacttccctttttcactgctttttgtctgttttgctctttgaggtcaagcctttcattcccactcccagaactgcagcagccttgttgttctttcttcctattgatgtcatgtccacttctgttgtcctcgcattccccagtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303219 - DNA, 1444 bp, Homo sapiens
accagaaggtcatgtcatcttcaactacaagggcagaacgtgctgatcaacaaggacatccgttgcacggatgatgagtttacacacctgtacacactgattgtgcggccagacaacacctatgaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303220 - DNA, 1392 bp, Homo sapiens
agatggtgagtgcagcattcatgaagaagtacatccatcttctcctttttcttcttggtcccatgtagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303221 - DNA, 1254 bp, Homo sapiens
ctccagccttgtacaatagagggagacctgagaaagttcagagcctggagagaagactgggagtcaggaactggatttaatgaggccattgttacgatggatcttgtgcctgtggagtcttttgtgaggcagtagccttatctgcggaggctgccgtgacgtagggtatgggcctaaataggccattgagagtcatgcgcttggtctgtagaggctgactggagaaagttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303222 - DNA, 935 bp, Homo sapiens
ttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggatggctgatggtgagtagatagagggtcgcttttttgtgggttttcattga

SEQ ID NO: 303223 - DNA, 689 bp, Homo sapiens
gtgtctgagggcatcatgacctgattgtcatcctgcatcttgctcagacaccatgacctgattgtcatcctgcatcttgctcagggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtaca

SEQ ID NO: 303224 - DNA, 1800 bp, Homo sapiens
ttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggtttgggagcaggttggcataggaaaatgctttcttcttggtgttcagattgatctggattgaggacaatgcaaggttttcctctggagacaaaagatcatttatatggattacttgatgtctgaactgattctatcaaacaattcctctcctcccctcatcaaattttaattgagaactactgtattcaaagcactattaggcgctatggaggacaaggatataaataagacccagtcctcgtcattagtcttcacagtggtggagaaatgaaacataaacaaaaacgaatgaatatcttagaattataacttaaacatactttagcatcatttagtctacctccagatgaaatgctgagatcagagaagttaaacaatttgcttacggtcccagttagtgatggccttaaggactaggacctgtgtctctttaattcatgccagttgtattttctaagtcattctgttgtcttcttcggaccttaagatctccacttttttagaatttcctcttcaggaagtacttgggaagtactcttctgttgattactgtggccaagcttctttacttgaaaagtgaaatacattggaccagatcttctggaggttgtctatggtgatgcttaagagcgtgggctttggagttaacacctgtatcaagtcaagactctgctacttaactgtgtgacctgggggaacttacttaatctctcctagtctcctggtttccttgtgcatgacgtgtgaaaataccttctttacaaagttgttgtgataattacatgagataattttgtgaagtaatagcacagtgcctggcacatagcaaacactcaataagtgacaactgtgtttttagaaaattcaaatgtgaaggaagtaaaactttaatatacgtacaggaaagctcacataagtgtatagcttgatgaatttttacaagctgagtacacctgtgtaaccagctccaaatgaggaaatattagcacacagaagtccctcttgagggctcatgttacctaggggtaaccactatcctgatgtctaacagtatggattactttcagctgttttttatttaaatacttatgggctttttatgctcaacattgtgtttatgagatttatccatgttgtgtataggtgtgtttcat

SEQ ID NO: 303225 - DNA, 154 bp, Homo sapiens
ttgtttttaatgatctaagaatgtctgctgttttgaggatccatttttttgagttctgcccagtctaatttttctttctcttgcttatgtacaggcttctgaacaatgcctttgaggagctggttgccttccagcgggccttaaaggattttgt

SEQ ID NO: 303226 - DNA, 338 bp, Homo sapiens
ccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgtaagtgggttaaagggggccgcttaggaaatgaatagacagggagatggggaaagcaggagaggcaaagtagatctgggtagcttgtggcttcaaagaggtggagcattggaattacgtggtaaaacttggagggctcagtgtgtacaatgattgggggaccttgagtaatcacatgtattagtagaatgatg

SEQ ID NO: 303227 - DNA, 853 bp, Homo sapiens
gttttcatctccctgcgttataaagcaccatcctctgaatttggtcgttgcatcgggtcaaaagttctgcagcttgaaaaaccctgcaaaaacatccggaaaggagggagaacactacaactcccagaacgcaatgctttccctctcgccagcctgtcccctccagctgctcaatgaccagcctctgtgagcctcctctcagccctattggtcagtttgctcgtcagtgagtgaggcggagggaggggaggaacagagaatcccggatggtacgtttcccgccaccgcggggcgcgcagcggaaaacccgaagaagaagaagcttttgattggacagtcgctagtccgacctcagagaactcagccaatcataatgcttatatgctcccaaggtccccgcctcttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggtgagggaggcgccggcgcgcgggctctagcgctcggagcccctgcggacgcggcccggccgggaagccagaggcccgccagacctccagaccgtgtgccgcagcggagcctgccgggcccgagcctccagccccaatcttgtaacttctcaacgccggactcgctagtttgtgttcgataagtgaactcttaggaagccagctttctcttaagtacaagcgatggtccgggcgcgcaaaaggcgacaggttcccatta

SEQ ID NO: 303228 - DNA, 2480 bp, Homo sapiens
aaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgattttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctatatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcatttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttctttttttgttttgttttttgttattgatattaaacagtgtaatctttgcaagcgtatattgaagattattctggagcatttattgccttaccagaaatgttagtaggaaatgttctttagagtagaaagatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttt

SEQ ID NO: 303229 - DNA, 3107 bp, Homo sapiens
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaaaaaacaagcttactgcaaaatacagctataaccctgaagcgcaacaatcaaaaaggagg

SEQ ID NO: 303230 - DNA, 3057 bp, Homo sapiens
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctggcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaaaaaacaagcttactgcaaaatacagctataaccctgaagcgcaacaatcaaaaaggagg

SEQ ID NO: 303231 - DNA, 3176 bp, Homo sapiens
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagctctttgcttctggatatgaagaatgtggccctccaagactttattgatagcagaggactggagccctgccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaaaaaacaagcttactgcaaaatacagctataaccctgaagcgcaacaatcaaaaaggagg

SEQ ID NO: 303232 - DNA, 2584 bp, Homo sapiens
tttttatgaatcatttatgggtaagttaaatacttcatagcccccaaaaattcattgttttttctccaaagaaaaggctagtctcttaccaaggtagtaactcgatttcatggctggatagtttggatagtggtagtgaaaccaggacatgtaacatcagaaatctgttcaatttgcagtcttaaaacatctgagtgtgttaaaacatcctctgtccttccttttgcagatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaaaaaacaagcttactgcaaaatacagctataaccctgaagcgcaacaatcaaaaaggagg

SEQ ID NO: 303233 - DNA, 2375 bp, Homo sapiens
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttt

SEQ ID NO: 303234 - DNA, 3053 bp, Homo sapiens
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaaaaaacaagcttactgcaaaatacagctataaccctgaagcgcaacaatcaaaaaggagg

SEQ ID NO: 303235 - DNA, 2520 bp, Homo sapiens
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaaaaaacaagcttactgcaaaatacagctataaccctgaagcgcaacaatcaaaaaggagg

SEQ ID NO: 303236 - DNA, 2958 bp, Homo sapiens
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttcaaaaatcccataaacacacgacataacaaataagggcccccataaaaatcccc

SEQ ID NO: 303237 - DNA, 3051 bp, Homo sapiens
  misc_feature (2910)..(2910): n is a, c, g, or t
  misc_feature (2916)..(2916): n is a, c, g, or t
  misc_feature (2932)..(2932): n is a, c, g, or t
  misc_feature (2960)..(2961): n is a, c, g, or t
  misc_feature (2964)..(2964): n is a, c, g, or t
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttcctcgntcctgnaaacagccgccggcgngcgcgcgcggcggtcgcgtggaagggtnnttntggagaggaaatatgaacttggtctctggattttaaatggctctagaatttttttttttttttttttttcttttatttttttttttt

SEQ ID NO: 303238 - DNA, 3052 bp, Homo sapiens
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgatttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaaaaaacaagcttactgcaaaatacagctataaccctgaagcgcaacaatcaaaaaggagg

SEQ ID NO: 303239 - DNA, 2329 bp, Homo sapiens
agagtatctggagcattgctgctggtgagctgagtgatcctaatcgttagggtagcatacattgagtctagtgacgtatgtttactaaaaagcagaatctggttgcactgcacgtatctgttcgcgacggctgagccagtaaaaaaggggccacggtgggctgatcgaagcgtttcgtgaagcaaacatacaagtgagttcagatatgagagagatgaaattattgtgcagtaatagttaaactggtaagttatttataggtaaagaacaactaatcataataaacgtagtgctagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaaaaaacaagcttactgcaaaatacagctataaccctgaagcgcaacaatcaaaaaggagg

SEQ ID NO: 303240 - DNA, 2321 bp, Homo sapiens
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttt

SEQ ID NO: 303241 - DNA, 1330 bp, Homo sapiens
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtatttttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttt

SEQ ID NO: 303242 - DNA, 792 bp, Homo sapiens
  misc_feature (688)..(688): n is a, c, g, or t
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgcattntgatgcaatcaatttaagatttgcctgatgtcatgccagggtgtctgatgtagctgagccatgggaagctgtgcacgtgagagcatgacagtcggagtgtactt

SEQ ID NO: 303243 - DNA, 972 bp, Homo sapiens
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagctctttgcttctggatatgaagaatgtggccctccaagactttattgatagcagaggactggagccctgccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattggtatgtattattgatacctttaacctcaaggtgagttgatagtatttggcatgcatctgtaatcccagctactcagaaggctgaggctgaagcaccatctaggagtttgaagccaacctgggcaacataatgagaatttgtctcttaaaaa

SEQ ID NO: 303244 - DNA, 813 bp, Homo sapiens
  misc_feature (762)..(762): n is a, c, g, or t
ccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgtaagttgattcccaaaagaagacctttgcaatatcagaatgttcttttccaagtttgtgggtttttttctttttctctttgaccaataaacatgtaagttagctgctgtgaaaatggcaggttggtgtaacctatgtaaaaaacatatatgcatgtgatcaaagcctagaaaggaatctgaatgaaggttaagagatataggaggaagaactatgtctaattttcttttttnccaaatttttttttttttttgggggaaaaaattttaaaaaaattttaaaaa

SEQ ID NO: 303245 - DNA, 380 bp, Homo sapiens
gctcttactggttctcatgtagcatgtcccattaatgttgcttgaagagtgagtttatgtgccttctgttttacaatattgggtaggcagcaatagattattttctgtttatggagaaagcatgctttgtagagccttaaaaacacacgtgttaatagctaaaactttaggtacgtgagggaaacaaatcttctaacatgttgcttaatgttagttaattgttttttgtcttccttaggctgacattttggatgtcaatcagatatttaaagatttggccatgatgatccatgaccagggtgatctgattggtatgtattattgatacctttaacctcaaggtgagttgatagtatttggcatgcatctgtaatcccagc

SEQ ID NO: 303246 - DNA, 424 bp, Homo sapiens
accaaggtagtaactcgatttcatggctggatagtttggatagtggtagtgaaaccaggacatgtaacatcagaaatctgttcaatttgcagtcttaaaacatctgagtgtgttaaaacatcctctgtccttccttttgcagatagcatagaagccaatgtggaaagctcagaggtgcacgtcgaaagagccactgaacagttacagcgagctgcttactatcaggtaaaagcgggtaccaaagaaagtcactctgtgttgcagactttttaggccatcagagtacattgacatattgagaacagctacagcctttgcttaggtttaagctaaaggaaagtagtcataattgcagtcccagttccatttttattattttcctttgcagatagatctacaaaaaataatcacaccttgaataaac

SEQ ID NO: 303247 - DNA, 406 bp, Homo sapiens
ttttagccctttctcctacgcatattattctccaccctgttcagtatggtttctgttcaggactcaaactggaatgcagattttcttcaaccactttacacccacttcttagttgagacagattgccagagtcctatgtaatcttacagattctgtgggtgtcaaaggatgttgcttctttatactgtgctaaggaagcccttgttttgtgtgtctgtgatgtgtttctggatgacagcagcaataataccatctactttctagggcagaagagaggcaaagagaggagcagctggtctcatttgacaggtaatagaattattcatacaacctgctggatagttgagatgggaatctatctcgttatattttaattttaaaaatcaatgaaaaaatagagggcaaa

SEQ ID NO: 303248 - DNA, 1538 bp, Homo sapiens
actctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggactcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303249 - DNA, 2521 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303250 - DNA, 2498 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactgaccaaaatgtagaaaaagtgatactattacatatgatacagttgcaagaatctaaagtgtggattttattccattgcacaatttgctagtgtatttcctgggtagtgtggtgctgaataaatgtcgacg

SEQ ID NO: 303251 - DNA, 2603 bp, Homo sapiens
actctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303252 - DNA, 2468 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagcacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303253 - DNA, 1952 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtgcgatatcggactcttctccattctccaccatgcaggacaaactatcttctctagagcgagtcaacggtagacatgcttgggaaagtagtcatacattacccactatagtaggaagttacat

SEQ ID NO: 303254 - DNA, 1699 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttagtgctagtgtgagccaccatacccagccacattttgacaaatgtatgcatctgtgtaaccaccactatagccatct

SEQ ID NO: 303255 - DNA, 1566 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtatctcgctcgggtcctctaaacagcc

SEQ ID NO: 303256 - DNA, 1456 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggactcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303257 - DNA, 1443 bp, Homo sapiens
aacctacatgctgcccaatgctgctgactttatcctgtgccatgcgtggattgcgagctggcaatccacgcatgggacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303258 - DNA, 1240 bp, Homo sapiens
cagagtccaaacagtgcccagagtccaaacagtgcccaaagtccaaacagtgccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303259 - DNA, 1085 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttgcgggtaccggagtcgaatcgaatctggctagaga

SEQ ID NO: 303260 - DNA, 1024 bp, Homo sapiens
gtgtaaaccagttgtgaggaagttaggaccttggggttacctaaagataatttatattaagttgttggtccataaaaactgggcagaattggccacgcgcggtgactcaacgcctgtaatcccagcactttgggaggccgacgcggactagtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303261 - DNA, 846 bp, Homo sapiens
attacctccacgtggaggaatactatttgacaggagagtaactcacatgaggctgtagccaggacaccacttctcccagagacgggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303262 - DNA, 3114 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctaccctatctccccttttatactaataatcttataaaaaaaaaaaaaacaaaaaaaaaaaaaaaaaaaaaagggggggggcggcaaaaaaaaaccccagcggggggcccaactcaagcggcaaccacgaggttttcttggacaccacggggcccccacataagggggcagggagactaaaacaaccagcaacaggcaggagagcgccccagccccatcaaacaaccacctcggactcggcgagaaacacctgcgcacaccaccgcaccatccctgcgtcacaagcacacccatccctcctgcggcgggcgcacactggcgcacccactccccccagaagagattaagtctacacacgcgacacataacacacttagcacgcgcctcacaggcgaaaccaccaccacattacacccacaccgacacaactctagctcgaggcatactgcgcaaaacatttacaccgagcgagccagcaaaccacactagccacgaccaccaccctacaacgcgaacacaccaaccaggcaagcaacagccgcgcccatcaaggcaccgaccgcacaatgccacgacacgccaccagaacgacgaaacccacacacgccagccaccacccaaccccgcagccggacagcaccccgccaagccaccacgcaaccacaaacaccgaaacacgcacgaaccgacaaccactcagacacctgactcatcagcccaccacacaagcaaacacacaaaaccaagaacc

SEQ ID NO: 303263 - DNA, 2316 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcaggagaattccagcagcaggagaatcgcggcgctcctctagat

SEQ ID NO: 303264 - DNA, 2470 bp, Homo sapiens
actctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303265 - DNA, 1811 bp, Homo sapiens
  misc_feature (1698)..(1698): n is a, c, g, or t
  misc_feature (1702)..(1702): n is a, c, g, or t
  misc_feature (1704)..(1704): n is a, c, g, or t
  misc_feature (1711)..(1711): n is a, c, g, or t
  misc_feature (1731)..(1731): n is a, c, g, or t
  misc_feature (1741)..(1741): n is a, c, g, or t
  misc_feature (1811)..(1811): n is a, c, g, or t
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgagctggtctcgaacacctgggctcaagtgatccgcctgcctcggcctgccgcnaagngntgggatnacaggtgtgagccaccccgntcaacaaggntttattatttaagttagttaaactttggatagattgtataatatatagtttaatgtaatcatgctaatgn

SEQ ID NO: 303266 - DNA, 1669 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttcctgacctcgtgatccacctgccttggcacccaaagtgttgggatta

SEQ ID NO: 303267 - DNA, 1263 bp, Homo sapiens
gctagtacgaggcctggtttgaattggccgaggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303268 - DNA, 1241 bp, Homo sapiens
ctaaaggcaacagaaggcacagatgtaaggcactgcagatatggtaaaggagctctggaagagcagaaaaggcccagtcgcagcagagaaggcaataaacaagcagatgaagacagtcaagggacccagaacctgtttacttcgcgtgagtccacattccaaaatgtgggactcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaaaa

SEQ ID NO: 303269 - DNA, 695 bp, Homo sapiens
ggcatttgaatgagaccatattaccctgagctatgttaaatctcttcataaagtgaatagtatgtgaaaacgataataatacctagcagcctgcttctaccgtggacttccctccatgaaattattcttccttcactgcttagtatagtactcacttatactatactggctcatttattagtatttataggttattattattatacttgatccatctgccaaactgtaagttagcggctacttgacccatacagaataagtattaataataaggggtttcaaatgctgaaacattatctttgcagtagttgctgatcaataagagtggtgaggtcttccatagatatttttaggaactattgatcattatcccacagctgtgaacagggcactcctggagagaagaaagctacatttcccattctcagattccaacaaatattgcagatagtatgttttctgacagagatcatgtttttggtagccttgccaggaaccctgtccttttctgccaaatcaatggcatgttttgggttttttgttttgttttgtttctagagacagggtcctgttctgttgcacaggatggagcgcagtggcgccatcacagctcactgcagcctcaaactcctgggctcaagggatcctccccacctcagcctcccaaagcactgggattacaggcttgcaccacc

SEQ ID NO: 303270 - DNA, 641 bp, Homo sapiens
ggcatttgaatgagaccatattaccctgagctatgttaaatctcttcataaagtgaatagtatgtgaaaacgataataatacctagcagcctgcttctaccgtggacttccctccatgaaattattcttccttcactgcttagtatagtactcacttatactatactggctcatttattagtatttataggttattattattatacttgatccatctgccaaactgtaagttagcggctacttgacccatacagaataagtattaataataaggggtttcaaatgctgaaacattataggaactattgatcattatcccacagctgtgaacagggcactcctggagagaagaaagctacatttcccattctcagattccaacaaatattgcagatagtatgttttctgacagagatcatgtttttggtagccttgccaggaaccctgtccttttctgccaaatcaatggcatgttttgggttttttgttttgttttgtttctagagacagggtcctgttctgttgcacaggatggagcgcagtggcgccatcacagctcactgcagcctcaaactcctgggctcaagggatcctccccacctcagcctcccaaagcactgggattacaggcttgcaccacc

SEQ ID NO: 303271 - DNA, 1453 bp, Homo sapiens
tcctggagccagtgtgtacgactccacagagcatttggattacactcctccgaatgctgaaggaaaaacgctcaaaatctcattcttcagggggaagcgttgccactccgaggtgcccactgggaacgaatcccaaagccacgagcgcctgcctagtggggaatgtgaactgttatcctgagagtcgtccttctctctccctggtccaggacagaaaatactgaatagacaggaatttctgaagtctaaacgcctccaatgataacaggagtgttattggaaagggaacaagcgagaagacacagtcttcgaggagttaagttttgctaatctaatgatgagactgcattcatgaagactgagtgaagactttattgcaccatcacatcactaaggtttttctccaacatgaacattctgatgaagtcgaaggcttgaggcctgactaaagcacatatcacactccctacacttccatgttttctctcccatgtggaccctctgatgcatatcaagattcaagcgcctgttgtagcccttcccacagtcctcacatttgtatggcttttctacactgtgaactttttcttgcacttcagagaatgaattctgtacaatgttcttcccatgctgctcacatttgagaggtgtttctctgctgtggcgtctctgatgggtcagacgagttgaggaccagctgaagcccttcccacactcatcacatttgtatggcttttctccagtgtgcactctttgatgagaatgaagctgtgaattctgagtaaatcttttcccacactcttcacatttgaaaggtttttccccactgtgcagtctctgatgtttcaaaagacacgaggcccagccaaaactcttcccacattccttacaattgtatggtctctctcctgtgtggaccttctggtgcatatcaagattaaacttactattgtagccctttccacacttctcacatttgtatggcttttctccagtgtgaactctctgatgggaatgaagatgtgaattttgagtaaatctcttcccacactcttcacattggaatggtttttctccactgtggagtctctcatgtttcaaaagacatggggcccgactaaagctcttcccacattccttacaattatacagtttctctcctgtatggacgcgctggtgaaagtcaagatccaacctccttttgtagcccttcccacactccacacatttgtatggtttttctccactatgggatctctggtgggaatagcattgtgaatttgtgtaaaatcctttcccacattcttcacatttgaatggtttttctccactgtggactcgctgatgtttcaaaagacacgaggcccatctgaagctcttcccacactctttacaattatatggcttctctcccgtgtggaccatatgatgcgtataaagatctcgcctacaa

SEQ ID NO: 303272 - DNA, 693 bp, Homo sapiens
ctctagaggacccccactaagggatcacgcctgttgtagcccttcccacagtcctcacatttgtatggcttttctacactgtgaactttttcttgcacttcagagaatgaattctgtacaatgttcttcccatgctgctcacatttgagaggtgtttctctgctgtggcgtctctgatgggtcagacgagttgaggaccagctgaagcccttcccacactcatcacatttgtatggcttttctccagtgtgcactctttgatgagaatgaagctgtgaattctgagtaaatcttttcccacactcttcacatttgaaaggtttttccccactgtgcagtctctgatgtttcaaaagacacgaggcccagccaaaactcttcccacattccttacaattgtatggtctctctcctgtgtggaccttctggtgcatatcaagattaaacttactattgtagccctttccacacttctcacatttgtatggcttttctccagtgtgaactttttcttgcactttagagaatgaattctgtacaatgttcttcccatgctgctcacatttgagaggtgatctctgctgtggcgttctgatgggtcagacgagttgaggacagttgatccctagtgggtacgactcgatcgtatcctgtctgccttccaggctaatgcccagaaaacctcgcggcaat

SEQ ID NO: 303273 - DNA, 630 bp, Homo sapiens
tcctggagccagtgtgtacgactccacagagcatttggattacactcctccgaatgctgaaggaaaaacgctcaaaatctcattcttcagggggaagcgttgccactccgaggtgcccactgggaacgaatcccaaagccacgagcgcctgcctagtggggaatgtgaactgttatcctgagagtcgtccttctctctccctggtccaggacagaaaatactgaatagacaggaatttctgaagtctaaacgcctccaatgataacaggagtgttattggaaagggaacaagcgagaagacacagtcttcgaggagttaagttttgctaatctaatgccacgtgcacagtaagaagctggcaagatgggccaatcaactgggaagcctatttgcataagaagattagggtggggcgaccagccttccccacgcactatgtaaacgtcataactgatcgaaccaatctatgacccctatgtaaatcagacactgcctcctcaaactggtctgtaaaactcagcacattcactgccagccgacccttttccgctcggagaccccttcctctatggaggaacccgtttctctttctcttcttcctattaaacctccgctcctaaactgaggag

SEQ ID NO: 303274 - DNA, 1268 bp, Homo sapiens
tgaagcactgatgttatcttaaacaaatgttttccctcttccaagaatgggtgaaatttatcaccagcatggattcagagataaaatactcaaagggaagtgcttactatgtgcctcatattttaatgtgtctctcctttgtgaactttcagatgagactgcattcatgaagactgagtgaagactttattgcaccatcacatcactaaggtttttctccaacatgaacattctgatgaagtcgaaggcttgaggcctgactaaagcacatatcacactccctacacttccatgttttctctcccatgtggaccctctgatgcatatcaagattcaagcgcctgttgtagcccttcccacagtcctcacatttgtatggcttttctacactgtgaactttttcttgcacttcagagaatgaattctgtacaatgttcttcccatgctgctcacatttgagaggtgtttctctgctgtggcgtctctgatgggtcagacgagttgaggaccagctgaagcccttcccacactcatcacatttgtatggcttttctccagtgtgcactctttgatgagaatgaagctgtgaattctgagtaaatcttttcccacactcttcacatttgaaaggtttttccccactgtgcagtctctgatgtttcaaaagacacgaggcccagccaaaactcttcccacattccttacaattgtatggtctctctcctgtgtggaccttctggtgcatatcaagattaaacttactattgtagccctttccacacttctcacatttgtatggcttttctccagtgtgaactctctgatgggaatgaagatgtgaattttgagtaaatctcttcccacactcttcacattggaatggtttttctccactgtggagtctctcatgtttcaaaagacatggggcccgactaaagctcttcccacattccttacaattatacagtttctctcctgtatggacgcgctggtgaaagtcaagatccaacctccttttgtagcccttcccacactccacacatttgtatggtttttctccactatgggatctctggtgggaatagcattgtgaatttgtgtaaaatcctttcccacattcttcacatttgaatggtttttctccactgtggactcgctgatgtttcaaaagacacgaggcccatctgaagctcttcccacactctttacaattatatggcttctctcccgtgtggaccatatgatgcgtataaagatctcgcctacaa

SEQ ID NO: 303275 - DNA, 1259 bp, Homo sapiens
agcccgaagtttttttacaaaatgttttccttttccccacggggggggggttatcccccccgggttgggagataaaatactcaaagggaagtgcttactatgtgcctcatattttaatgtgtctctcctttgtgaactttcagatgagactgcattcatgaagactgagtgaagactttattgcaccatcacatcactaaggtttttctccaacatgaacattctgatgaagtcgaaggcttgaggcctgactaaagcacatatcacactccctacacttccatgttttctctcccatgtggaccctctgatgcatatcaagattcaagcgcctgttgtagcccttcccacagtcctcacatttgtatggcttttctacactgtgaactttttcttgcacttcagagaatgaattctgtacaatgttcttcccatgctgctcacatttgagaggtgtttctctgctgtggcgtctctgatgggtcagacgagttgaggaccagctgaagcccttcccacactcatcacatttgtatggcttttctccagtgtgcactctttgatgagaatgaagctgtgaattctgagtaaatcttttcccacactcttcacatttgaaaggtttttccccactgtgcagtctctgatgtttcaaaagacacgaggcccagccaaaactcttcccacattccttacaattgtatggtctctctcctgtgtggaccttctggtgcatatcaagattaaacttactattgtagccctttccacacttctcacatttgtatggcttttctccagtgtgaactctctgatgggaatgaagatgtgaattttgagtaaatctcttcccacactcttcacattggaatggtttttctccactgtggagtctctcatgtttcaaaagacatggggcccgactaaagctcttcccacattccttacaattatacagtttctctcctgtatggacgcgctggtgaaagtcaagatccaacctccttttgtagcccttcccacactccacacatttgtatggtttttctccactatgggatctctggtgggaatagcattgtgaatttgtgtaaaatcctttcccacattcttcacatttgaatggtttttctccactgtggactcgctgatgtttcaaaagacacgaggcccatctgaagctcttcccacactctttacaattatatggcttctctcccgtgtggaccatatgatgcgtataaagatctcgcctacaa

SEQ ID NO: 303276 - DNA, 490 bp, Homo sapiens
tgattcgcctgccggagccaagctgaccgctactccactgagcgtctggactaccattcccagaattgcttgtatcctcctcctggagccagtgtgtacgactccacagagcatttggattacactcctccgaatgctgaaggaaaaacgctcaaaatctcattcttcagggggaagcgttgccactccgaggtgcccactgggaacgaatcccaaagccacgagcgcctgcctagtggggaatgtgaactgttatcctgagagtcgtccttctctctccctggtccaggacagaaaatactgaatagacaggaatttctgaagtctaaacgcctccaatgataacaggagtgttattggaaagggaacaagcgagaagacacagtcttcgaggagttaagttttgctaatctaatggtaagaaatggtttctaaatgtagttttaatttgtatttgttcttttgtaaataaagtggaacatccgtgcat

SEQ ID NO: 303277 - DNA, 1285 bp, Homo sapiens
tcctggagccagtgtgtacgactccacagagcatttggattacactcctccgaatgctgaaggaaaaacgctcaaaatctcattcttcagggggaagcgttgccactccgaggtgcccactgggaacgaatcccaaagccacgagcgcctgcctagtggggaatgtgaactgttatcctgagagtcgtccttctctctccctggtccaggacagaaaatactgaatagacaggaatttctgaagtctaaacgcctccaatgataacaggagtgttattggaaagggaacaagcgagaagacacagtcttcgaggagttaagttttgctaatctaatgatgagactgcattcatgaagactgagtgaagactttattgcaccatcacatcactaaggtttttctccaacatgaacattctgatgaagtcgaaggcttgaggcctgactaaagcacatatcacactccctacacttccatgttttctctcccatgtggaccctctgatgcatatcaagattcaagcgcctgttgtagcccttcccacagtcctcacatttgtatggcttttctccagtgtgcactctttgatgagaatgaagctgtgaattctgagtaaatcttttcccacactcttcacatttgaaaggtttttccccactgtgcagtctctgatgtttcaaaagacacgaggcccagccaaaactcttcccacattccttacaattgtatggtctctctcctgtgtggaccttctggtgcatatcaagattaaacttactattgtagccctttccacacttctcacatttgtatggcttttctccagtgtgaactctctgatgggaatgaagatgtgaattttgagtaaatctcttcccacactcttcacattggaatggtttttctccactgtggagtctctcatgtttcaaaagacatggggcccgactaaagctcttcccacattccttacaattatacagtttctctcctgtatggacgcgctggtgaaagtcaagatccaacctccttttgtagcccttcccacactccacacatttgtatggtttttctccactatgggatctctggtgggaatagcattgtgaatttgtgtaaaatcctttcccacattcttcacatttgaatggtttttctccactgtggactcgctgatgtttcaaaagacacgaggcccatctgaagctcttcccacactctttacaattatatggcttctctcccgtgtggaccatatgatgcgtataaagatctcgcctacaa

SEQ ID NO: 303278 - DNA, 1332 bp, Homo sapiens
gggtgctatagacgcacaaacgaccgcgagccacaaatcaagcacacatatcaaaaaacaaatgagctcttattttgtaaactcattttgcggtcgctatccaaatggcccggactaccagttgcataattatggagatcatagttccgtgagcgagcaattcagggactcggcgagcatgcactccggcaggtacggctacggctacaatggcatggatctcagcgtcggccgctcgggctccggccactttggctccggagagcgcgcccgcagctacgctgccagcgccagcgcggcgcccgccgagcccaggtacagccagccggccacgtccacgcactctcctcagcccgatccgctgccctgctccgccgtggccccctcgcccggcagcgacagccaccacggcgggaaaaactccctaagcaactccagcggcgcctcggccgacgccggcagcacccacatcagcagcagagagggggttggcacggcgtccggagccgaggaggacgcccctgccagcagcgagcaggcgagtgcgcagagcgagccgagcccggcgccgcccgcccaaccccagatctacccctggatgcgcaagctgcacataagtcatgacaacataggcggcccggaaggcaaaagggcccggacggcctacacgcgctaccagaccctggagctggagaaggagttccacttcaaccgttacctgacccgcagaaggaggattgaaatagcacatgctctttgcctctccgagagacaaattaaaatctggttccaaaaccggagaatgaagtggaaaaaagataataagctgaaaagcatgagcatggccgcggcaggaggggccttccgtccctgagtatctgagcgtttaaagtactgagcagtattagcggatcccgcgtagtgtcagtactaaggtgactttctgaaactcccttgtgttccttctgtgaagaagccctgttctcgttgccctaattcatcttttaatcatgagcctgtttattgccattatagcgcctgtataagtagatctgctttctgttcatctctttgtcctgaatggctttgtcttgaaaaaaaatagatgttttaacttatttatatgaagcaagctgtgttacttgaagtaactataacaaaaaaagaaaagagaaaaaaaaacacacaaaaagtcccccttcaatctcgtttagtgccaatgttgtgtgttgcactcaagttgtttaactgtgcatgtgcgtggaagtgttcctgtctcaatagctccaagctgttaaagatatttttattcaaactacctatattccttgt

SEQ ID NO: 303279 - DNA, 759 bp, Homo sapiens
cgccttgggacgcgctcccgggtcaggccagccgagcaaggcgcagagagacaacataggcggcccggaaggcaaaagggcccggacggcctacacgcgctaccagaccctggagctggagaaggagttccacttcaaccgttacctgacccgcagaaggaggattgaaatagcacatgctctttgcctctccgagagacaaattaaaatctggttccaaaaccggagaatgaagtggaaaaaagataataagctgaaaagcatgagcatggccgcggcaggaggggccttccgtccctgagtatctgagcgtttaaagtactgagcagtattagcggatcccgcgtagtgtcagtactaaggtgactttctgaaactcccttgtgttccttctgtgaagaagccctgttctcgttgccctaattcatcttttaatcatgagcctgtttattgccattatagcgcctgtataagtagatctgctttctgttcatctctttgtcctgaatggctttgtcttgaaaaaaaatagatgttttaacttatttatatgaagcaagctgtgttacttgaagtaactataacaaaaaaagaaaagagaaaaaaaaacacacaaaaagtcccccttcaatctcgtttagtgccaatgttgtgtgttgcactcaagttgtttaactgtgcatgtgcgtggaagtgttcctgtctcaatagctccaagctgttaaagatatttttattcaaactacctatattccttgt

SEQ ID NO: 303280 - DNA, 564 bp, Homo sapiens
ctttctgaaactcccttgtgttccttctgtgaagaagccctgttctcgttgccctaattcatcttttaatcatgagcctgtttattgccattatagcgcctgtataagtagatctgctttctgttcatctctttgtcctgaatggctttgtcttgaaaaaaaatagatgttttaacttatttatatgaagcaagctgtgttacttgaagtaactataacaaaaaaagaaaagagaaaaaaaaacacacaaaaagtcccccttcaatctcgtttagtgccaatgttgtgtgttgcactcaagttgtttaactgtgcatgtgcgtggaagtgttcctgtctcaatagctccaagctgttaaagatatttttattcaaactacctatattccttgtgtaattaatgctgttgtagaggtgacttgatgagacacaacttgttcgacgtgtagtgactagtgactctgtgatgaaaactgtgactccaagcggtgtgtccctgcgtgcctttataggaccctttgcacgaactctggaagtggctcttataagcgcagcttcagtgat

SEQ ID NO: 303281 - DNA, 908 bp, Homo sapiens
cccgggggttatgggaggggggcggcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccaagaccacgacaggatctttcaataggcaagtctccacagaaaccaggccgcaacgggacgggcagagcgggagaaa

SEQ ID NO: 303282 - DNA, 659 bp, Homo sapiens
tccccctgtgggtttgcacttgccagcattgctgagaactgtctgaggagaagttcagaggcttggcacctgctctggaagctactctggaatcttaattctaaggccaatggctgcccaccccaacgggcagcaacagcagggccaaggtcttgtgacaatgtctggaggtgcccctattgtcacactgggggtctcctactggcctgcaatgggaggaggggctgcagccccacatcctgtgcagagtgctagtgctgaggcggaaccctcctcagagctgccccttctcctccaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303283 - DNA, 533 bp, Homo sapiens
aaacctgcattgtggagtccccctggcccttgtgggatggacagctgaggtcttctgcacagctgccatttcactgtgggagccaagctgcctcgccagctgggcagggactggaacggctcccagcctgtgtgcctctcaaggctaatctctggtctcctattgtcactgccccactgtgtgccaatggggactcctgtttatttctggcagcttctctttgaggcaggacttacttggaacctacagtgggtcctatgtgacttctttgcaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303284 - DNA, 413 bp, Homo sapiens
cagtcagagtcctcagaggttccaagctggcaaagttcaggttaacagtggcctgtgtggaaggatctcttgagaacagaagttcaagaccagcatgggcaacatagcgaggctccgtctctacaaaatatataaaattagctgtagtcccagctactcgggaggctgaggcaggagaatggcgtgaacccgggaggcggagcttgcagtgagctgagatcgcgccactgcactccagcctggatgacagcgagactccgcctcaaaacaaaaacaaaaacagaaacaacaataacagaaaaacacagacatttactctctggcagttctggaggccagaagttgaaatccagatgtcagccggcacatgggttctctccagtcacgacgaggggagaatcaccgcccggcct

SEQ ID NO: 303285 - DNA, 1617 bp, Homo sapiens
aggccgtgggtaaatcggccgagggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303286 - DNA, 1620 bp, Homo sapiens
  misc_feature (22)..(22): n is a, c, g, or t
  misc_feature (29)..(29): n is a, c, g, or t
taggctagtagaggcccgtgtnaatcggncgagggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303287 - DNA, 1613 bp, Homo sapiens
ctgatacggtccgcaatccctgttgaggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303288 - DNA, 2168 bp, Homo sapiens
  misc_feature (1707)..(1707): n is a, c, g, or t
aggccgtgggtaaatcggccgagggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcgaaaaaaaaaagtgccttcccctcccgggcccaggctccccgtgcgcgggccctgccctttcctcccgagccccaccggatccgacgcgcanacccgctcagcagtcacagaagcagggccagccacctgggtcttaacgaggagtccagggagtagggagaatgttcttcccggcaacatacctacgctaatactggtctggaaagggaatcttccatactggacaagttccaataatttccaaccgtggttcaaaagtggaatttggtcccattccaaccttcaacaaggagaagccttcccagcgccataagatcgggaaccgcgggaaaacccgcttcgtagaaccccagtattgaataccccgggaagaagcgcggtcaccgcaaacgaccacagactacatatcaggaagtggagacaccccacaagcaacgcgtgtgacatgacgaacgactacacagtatcacaattagacgacagcgcggatgacacaatcggcaagacaacaccactgatcacacagcttctaaccaagaagacgttacatcc

SEQ ID NO: 303289 - DNA, 1771 bp, Homo sapiens
ccacgcgtccgggcgggatgcggcgcgccgcgcgggtgagacatcggtatccaggcacgataaatttccaagtggacacaatgtctggtgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303290 - DNA, 1762 bp, Homo sapiens
cttgtctggaaatgagacaggtgccggagagctggatggaggcagatcgggaattccatttggggcaaactgaacttgattgagaccctggtagttgtccagatggaacaggacacctgagtctagggttcgggaagaactccagatgggacaaacactcctagctttccttttctctttttggatgaccgctacaggtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303291 - DNA, 2432 bp, Homo sapiens
agcgggagttgcggcgatgggcggggcaggcgcgcggggattggcgggatgcggcgcgccgcgcggtgagtggggtccagggaaacggggtcagctgggggtggcagttccaggccgcgaggccgggctcctgggtcggtgggctggtgtcttggcggacgtcccgcagctgccgcgtggatccgagccggggcacccgccgtgactgggacagcccccagggcgctctcggccccatcccgagtagcgcggcctggctgctgccgccatcaagcacgttcgagccaaaagctcctaacgagtcactcgttagacacgtgtgcggagcctgtgtcccaggccagtgctgtcccgtggagatagattgcaagccgctagggaattttttaactttctagtaggtgtacgaaaaaagtaaaacgaaacaaatcaattggagtaaatccataaatatattcaaactattatttcaattgtatgtgaaaacaattattgggatattctttgtactattcttagaaatccattgtgtgtccaacccaaacatcacagttggactcaccacatctcctgtacttcgtagccctaggtggctagtggcataagacacaaaaatctcagctctcctggagcttatggtctagttggagcaggcagacaatacatttaaaatatacagtttgttagaaggtgccggagagctggatggaggcagatcgggaattccatttggggcaaactgaacttgattgagaccctggtagttgtccagatggaacaggacacctgagtctagggttcgggaagaactccagatgggacaaacactcctagctttccttttctctttttggatgaccgctacaggtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303292 - DNA, 1629 bp, Homo sapiens
agcgggagttgcggcgatgggcggggcaggcgcgcggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303293 - DNA, 1716 bp, Homo sapiens
agcgggagttgcggcgatgggcggggcaggcgcgcggggattggcgggatgcggcgcgccgcgcggtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303294 - DNA, 1623 bp, Homo sapiens
aggccgtgggtaaatcggccgagggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303295 - DNA, 1878 bp, Homo sapiens
ctgatacggtccgcaatccctgttgaggcgggatgcggcgcgccgcgcggtgccggagagctggatggaggcagatcgggaattccatttggggcaaactgaacttgattgagaccctggtagttgtccagatggaacaggacacctgagtctagggttcgggaagaactccagatgggacaaacactcctagctttccttttctctttttggatgaccgctacagggtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303296 - DNA, 1591 bp, Homo sapiens
cccgggggttatgggaggggggcggcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303297 - DNA, 1601 bp, Homo sapiens
ggacgcgtgggtcgacccacgcgtcgcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303298 - DNA, 2385 bp, Homo sapiens
agcgggagttgcggcgatgggcggggcaggcgcgcggggattggcgggatgcggcgcgccgcgcggtgagtggggtccagggaaacggggtcagctgggggtggcagttccaggccgcgaggccgggctcctgggtcggtgggctggtgtcttggcggacgtcccgcagctgccgcgtggatccgagccggggcacccgccgtgactgggacagcccccagggcgctctcggccccatcccgagtagcgcggcctggctgctgccgccatcaagcacgttcgagccaaaagctcctaacgagtcactcgttagacacgtgtgcggagcctgtgtcccaggccagtgctgtcccgtggagatagattgcaagccgctagggaattttttaactttctagtaggtgtacgaaaaaagtaaaacgaaacaaatcaattggagtaaatccataaatatattcaaactattatttcaattgtatgtgaaaacaattattgggatattctttgtactattcttagaaatccattgtgtgtccaacccaaacatcacagttggactcaccacatctcctgtacttcgtagccctaggtggctagtggcataagacacaaaaatctcagctctcctggagcttatggtctagttggagcaggcagacaatacatttaaaatatacagtttgttagaaggtaaatgttgtaaacaacaataacagttgaagtactggggagagttgcagttgtagaatcagatgggcagggcacaaggtaacatttgagtaaagatgtcagaacttgaaggagatgggcaagtgagctcttgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303299 - DNA, 1649 bp, Homo sapiens
tctctgggcgtcccagggactgggcgcacagtggtcggcgggatgaggcgcctggtgacggacggggcgaggagggcagcgattgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303300 - DNA, 2254 bp, Homo sapiens
agcgggagttgcggcgatgggcggggcaggcgcgcggggattggcgggatgcggcgcgccgcgcggtgagtggggtccagggaaacggggtcagctgggggtggcagttccaggccgcgaggccgggctcctgggtcggtgggctggtgtcttggcggacgtcccgcagctgccgcgtggatccgagccggggcacccgccgtgactgggacagcccccagggcgctctcggccccatcccgagtagcgcggcctggctgctgccgccatcaagcacgttcgagccaaaagctcctaacgagtcactcgttagacacgtgtgcggagcctgtgtcccaggccagtgctgtcccgtggagatagattgcaagccgctagggaattttttaactttctagtaggtgtacgaaaaaagtaaaacgaaacaaatcaattggagtaaatccataaatatattcaaactattatttcaattgtatgtgaaaacaattattgggatattctttgtactattcttagaaatccattgtgtgtccaacccaaacatcacagttggactcaccacatctcctgtacttcgtagccctaggtggctagtggcataagacacaaaaatctcagctctcctggagcttatggtctagttggagcaggcagacaatacatttaaaatatacagtttgttagaagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303301 - DNA, 1877 bp, Homo sapiens
ctgatacggtccgcaatccctgttgaggcgggatgcggcgcgccgcgcggtgccggagagctggatggaggcagatcgggaattccatttggggcaaactgaacttgattgagaccctggtagttgtccagatggaacaggacacctgagtctagggttcgggaagaactccagatgggacaaacactcctagctttccttttctctttttggatgaccgctacaggggtgagacatcggtatccaggcacgataaatttccaagtggacacaatgtctggtgtcaactacagctgttctccttcttttcccatgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303302 - DNA, 1572 bp, Homo sapiens
aggccgtgggtaaatcggccgagggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303303 - DNA, 1515 bp, Homo sapiens
aggccgtgggtaaatcggccgagggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303304 - DNA, 1554 bp, Homo sapiens
aggccgtgggtaaatcggccgagggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagccagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303305 - DNA, 1494 bp, Homo sapiens
aggccgtgggtaaatcggccgagggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303306 - DNA, 1300 bp, Homo sapiens
  misc_feature (1132)..(1134): n is a, c, g, or t
  misc_feature (1139)..(1139): n is a, c, g, or t
aggccgtgggtaaatcggccgagggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagcatnnnggggncgattggggcttccgcgaccggtgaattcgaaaggggggggcactggaccgggggcctggggcgataacaagcggacaggtggccttaaaagcggtcaagcgggtctggggcccgtggccaccggggaaagggggcgacgcgagaaaggccatggagaggg

SEQ ID NO: 303307 - DNA, 2021 bp, Homo sapiens
cagtcagagtcctcagaggttccaagctggcaaagttcaggttaacagtggcctgtgtggaaggatctcttgagaacagaagttcaagaccagcatgggcaacatagcgaggctccgtctctacaaaatatataaaattagctgtagtcccagctactcgggaggctgaggcaggagaatggcgtgaacccgggaggcggagcttgcagtgagctgagatcgcgccactgcactccagcctggatgacagcgagactccgcctcaaaacaaaaacaaaaacagaaacaacaataacagaaaaacacagacatttactctctggcagttctggaggccagaagttgaaatccagatgtcagcaggattggctccttctgaaggcccgaggggagggtccttcctggcctcctccctggtgttcctgggcttgtggccgcatcactccgctctgcccgtcttcacactccctcttgtctgtgtgtctgtctctctgttctcatgaggacacttggcatccagggcccaaccacacccagagtccctggtctcctgtggctgactcactttttactgtcaccgtgaagtccagggggtccttgtacttgatgttctctcctggcaagggccagggccctgtgattggcctctcatggagtgctgggcagggcctccatggcctctgtcgggcgggggggctacttcatctctgagtctgtacccctcgtgtcccaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303308 - DNA, 1190 bp, Homo sapiens
atacctcctgtctctgcattccagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303309 - DNA, 1202 bp, Homo sapiens
aggccgtgggtaaatcggccgagggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303310 - DNA, 1192 bp, Homo sapiens
gtgacagctgattcttgagggtaaaccgacgctcagccagctggcccagattgctctgggccatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303311 - DNA, 1664 bp, Homo sapiens
agcgggagttgcggcgatgggcggggcaggcgcgcggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacgggtagggagcccaatgagaggatgtgggtgatgcagggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303312 - DNA, 2056 bp, Homo sapiens
cagtcagagtcctcagaggttccaagctggcaaagttcaggttaacagtggcctgtgtggaaggatctcttgagaacagaagttcaagaccagcatgggcaacatagcgaggctccgtctctacaaaatatataaaattagctgtagtcccagctactcgggaggctgaggcaggagaatggcgtgaacccgggaggcggagcttgcagtgagctgagatcgcgccactgcactccagcctggatgacagcgagactccgcctcaaaacaaaaacaaaaacagaaacaacaataacagaaaaacacagacatttactctctggcagttctggaggccagaagttgaaatccagatgtcagcaggattggctccttctgaaggcccgaggggagggtccttcctggcctcctccctggtgttcctgggcttgtggccgcatcactccgctctgcccgtcttcacactccctcttgtctgtgtgtctgtctctctgttctcatgaggacacttggcatccagggcccaaccacacccagagtccctggtctcctgtggctgactcactttttactgtcaccgtgaagtccagggggtccttgtacttgatgttctctcctggcaagggccagggccctgtgattggcctctcatggagtgctgggcagggcctccatggcctctgtcgggcgggggggctacttcatctctgagtctgtacccctcgtgtcccaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacgggtagggagcccaatgagaggatgtgggtgatgcagggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303313 - DNA, 1032 bp, Homo sapiens
aggccgtgggtaaatcggccgagggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataagcaaatacctcacaagaaaccgagcagcagggtggaggtgtaagatgcggatgaatccccggggtgaggccccagtgccgggacgtatgccgcgagttggccccataaagtcccagagaccccccggtgtcccgggaccggaac

SEQ ID NO: 303314 - DNA, 1521 bp, Homo sapiens
ccacgcgtccgggcgggatgcggcgcgccgcgcgggtgagacatcggtatccaggcacgataaatttccaagtggacacaatgtctggtgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303315 - DNA, 922 bp, Homo sapiens
cgacccacgcgtcggacccacgcgtcgcccacgcgtcgggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303316 - DNA, 1402 bp, Homo sapiens
ccacgcgtccgggcgggatgcggcgcgccgcgcgggtgagacatcggtatccaggcacgataaatttccaagtggacacaatgtctggtgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303317 - DNA, 1458 bp, Homo sapiens
ccacgcgtccgggcgggatgcggcgcgccgcgcgggtgagacatcggtatccaggcacgataaatttccaagtggacacaatgtctggtgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattggccaaatacctcaccaagaaaacccaggcagccagcgtggaggctgttaagatgctggatgagatcctcctgcagctgagccagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303318 - DNA, 943 bp, Homo sapiens
gaggtctcgcaggtcggtgggaagcgccctgcagtgactctggggcctcctgcaatggggctcctcatgcccaggccctcgctgaggatggtgggaggcttgaagggagtgagggtctatgggacaacaactgcatcttccagctggtggggctctactctcctctgagcctgggactcgcctgggcctgatggccttctgggcttctattccaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303319 - DNA, 991 bp, Homo sapiens
ggacgcgtgggcggggcagcttggggacgaaggggagcagtgcagcgccgtcaccacatccaccagcagctgggtgcccagcaggctctcgcctccaccgccacccaggcccaggccggacacagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303320 - DNA, 1520 bp, Homo sapiens
agcgggagttgcggcgatgggcggggcaggcgcgcggggattggcgggatgcggcgcgccgcgcggtgagtggggtccagggaaacggggtcagctgggggtggcagttccaggccgcgaggccgggctcctgggtcggtgggctggtgtcttggcggacgtcccgcagctgccgcgtggatccgagccggggcacccgccgtgactgggacagcccccagggcgctctcggccccatcccgagtagcgcggcctggctgctgccgccatcaagcacgttcgagccaaaagctcctaacgagtcactcgttagacacgtgtgcggagcctgtgtcccaggccagtgctgtcccgtggagatagattgcaagccgctagggaattttttaactttctagtaggtgtacgaaaaaagtaaaacgaaacaaatcaattggagtaaatccataaatatattcaaactattatttcaattgtatgtgaaaacaattattgggatattctttgtactattcttagaaatccattgtgtgtccaacccaaacatcacagttggactcaccacatctcctgtacttcgtagccctaggtggctagtggcataagacacaaaaatctcagctctcctggagcttatggtctagttggagcaggcagacaatacatttaaaatatacagtttgttagaaggtgccggagagctggatggaggcagatcgggaattccatttggggcaaactgaacttgattgagaccctggtagttgtccagatggaacaggacacctgagtctagggttcgggaagaactccagatgggacaaacactcctagctttccttttctctttttggatgaccgctacaggtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaaagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303321 - DNA, 914 bp, Homo sapiens
ccacgcgtccgggcgggatgcggcgcgccgcgcgggtgagacatcggtatccaggcacgataaatttccaagtggacacaatgtctggtgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtgagcagcagttctcgggagctggaaccagctcatggtcagtggaatctttgagttgcacctaggaggg

SEQ ID NO: 303322 - DNA, 692 bp, Homo sapiens
agcgggagttgcggcgatgggcggggcaggcgcgcggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacgggtagggagcccaatgagaggatgtgggtgatgcaggtgaagagcccagcggtggtgtgttagggatggtgtgagtggggagcctggggggagtgggggggtgtgg

SEQ ID NO: 303323 - DNA, 814 bp, Homo sapiens
agcgggagttgcggcgatgggcggggcaggcgcgcggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatagcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303324 - DNA, 656 bp, Homo sapiens
agcgggagttgcggcgatgggcggggcaggcgcgcggggattggcgggatgcggcgcgccgcgcgtgaacctccttggcctgggcgaagctgtgtggaccaagcaagtcagcagcccctccacccctgcatgttcccgctggccactgcctactccacgctccagctggtcaccaacccctaccaggccaccattgatggagtcagagtcagatttttggggacatcaggacagaacgtgagtgacattttccgatacagcagcatggaggatcacttggagatcctggagtggaccctgcgggtccgtcacatcagccccacagcccctgacactctaggcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 303325 - DNA, 781 bp, Homo sapiens
aaatacttactggtccagtgagttatgcaggtattccagtgtgttgacattatacaacaccagaaaaaccacattcatgaacatcactaccagacccatagaaacgggtttaagcattggaaagctttcaagctcccagtggctgatacaaattttccaaaattctagtttttcttgaaagctctaattttatcatttgtttttcttgaaggacaggctcacttcattttctagaaaatgtctggcaaattcccaagtctgaatgtctgaatagctttagtttgtctgccattctttcaagtaaaaacagtgttctgtgagaaaagcagctggttcatcttgtttctcagttgcacaagtgcttttccttaaggacagccgtgacagtgaagtgtgtatacagcagaagcactttatgaatacttaccatttagtcatacagaagactagaaagattagtacttaagggttgaagtttttaaaaattaatttgggctacgtgattcaaggacatagttgaaactttttgtgtgttttttaaaactgcaaaagtgtggtggtgaaaaatatagggactgctagtatagtttgatgccactgctttgatttactctaaagtacaagaagaatttgtttgtttatagtttagtaatttttagtaacttaactgagtgatataaccatcacaagtcagttttagaacatttttattgccccagtaagaaccatcatgcctgtggaactattttctttgaacagaaacagcctgtggaaaagaaaa

SEQ ID NO: 303326 - DNA, 940 bp, Homo sapiens
tgtaattgtctccaaatcccctttgcgccccttcttccgtaattttgaaggagagaatagcacacatccacaactgaatagctctcgggtccgggcctgtagggcttaagcattccgaatgtcttcctttatttcgtcccattatctctgtttcctttagtcccaactggcagtgtttctcctggtataatcccatttctagtcatggtttgtgttgagatgtttgattaagcctgtggttcacacccatattaatcaaatcagtaagggtccgaaacactcttcatgttctcttcagaacacactttctcactttttttgcaatatggacaggctgagaatttcccagatcttaaattatggttactttttccttaacaattccatcttcaaacctttttctttttctacatttgactctacggattcagaaggaaccaagctgctgcttctacatgttgctgagaaatctgctgggttaaatgtccaatttcactgcacacaagttccaccttccgcaaaacacaagagcatgaatacaattcaaagaagtttgtttccacttttcaacatggattgcttttgctccattttccaataacattttcatttccatttgagactccaacagaatgacctttactgtccatattttatcaatattctgttcatgattatttaattattttctgagaagacagcgttttcttctatatttctttccgagccctcacgagaattggcttttaaatttcttccacagtaatctagcattttgcataaaacctcatcaatctctgccaatcactgagcccaaaaccattttcactttgttttaggtatttataataacagcactcccacttctcatgatcaatttccatcttcagcggttcaggctgctttaataaagttccataacctgagtggcttttaaata

SEQ ID NO: 303327 - DNA, 585 bp, Homo sapiens
  misc_feature (487)..(487): n is a, c, g, or t
  misc_feature (496)..(496): n is a, c, g, or t
  misc_feature (504)..(504): n is a, c, g, or t
  misc_feature (526)..(526): n is a, c, g, or t
  misc_feature (543)..(543): n is a, c, g, or t
  misc_feature (559)..(559): n is a, c, g, or t
tacgggcacctggagttgattcagctgcagctggccgcccagtttgagaattggtgtaagacatcacaatcccattattcagagcgcgtatggagtggaaacgcttgtaaggcttcaccaggatccacctctgatgttcagtgaagaggaccggaaaagtctgctagagcagtgccatctgggtctggatcaaaaacgcagaaaatacgtggttggagagctcatctggaattttgccgatttcatgactaaccagtggctggtgaattaccagatctccgtcaagtgcattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccacatcggggtgttgcttaatttaactaatgntaatgagtnggggcagnaccaaaaccaggagagcaggancggtctcattggcacancgcctgaactggtgtncttccagggttccaaagtcctacctc

SEQ ID NO: 303328 - DNA, 1312 bp, Homo sapiens
tacgggcacctggagttgattcagctgcagctggccgcccagtttgagaattggtgtaagacatcacaatcccattattcagagcgcgtatggagtggaaacgcttgtaaggcttcaccaggatccacctctgatgttcagtgaagaggaccggaaaagtctgctagagcagtgccatctgggtctggatcaaaaacgcagaaaatacgtggttggagagctcatctggaattttgccgatttcatgactaaccagtgtaagtggcagtttagcgcatgggataatgtacccgtcctcattttttcaggttgccttgcccattctggacattttggctgtaagaatattggaaacaaaggggggaacctggtttaatccatgtaggttgtgttgagaatttcctaggaaaagtaagttgtgcttaggaagtaggaaagcagtcaggcccccgcttcccacgtacggtcaaaaagcaaacatgagagtctgctatagtgagatggaaatggctagcttgcctttttcttgtctatttcatagccaaggatgaaggaaaaactggacctcattatggatttacttttgggatacactcattattccagaggagggtaaaaggctgagaagcttaaggtatttcagtctgttttatgttactcatttgcgaaaagcaggctcatcgaatacaggtgagtttcaacgcgtcttgaatatggcagcatttaaaagtcttcagaccaggcatggtggctcatgcctgtcatcccagcactttgggaggccaaggtgggaggattgcttgaggccaggagttcgagaccagcctgttcagcatagcaggacccccatctctacaaaaactaaacagattagctaggtgtggtggtgtgtgcctgtagtcctagctgcttgggaggctgaggcaggcggatagcctgagcacaggagttggaggctgcagtaagccatgattacaccactgcacttgagcctgggcagcagagtgagacctgtctttaaaaaaaaaaaggagctgggcacggtggctcatgcctgtaatcccagcactttgggaggccgaggcaggcagatcacgaggtcaggagatcgagaccatcctggctaacagtgaaaccctgtctctactgaaaatacaaaaaaaatcagccgggcgtggtggcgggtgcctgtagtcccagctgctcgggaggctgaggcaggagaatggcatgaacccaggagttggagcttgcagtgagccgagattgtgccactgcactccagcctgggcgacagtgagactgcttctca

SEQ ID NO: 303329 - DNA, 1028 bp, Homo sapiens
tacgggcacctggagttgattcagctgcagctggccgcccagtttgagaattggtgtaagacatcacaatcccattattcagagcgcgtatggagtggaaacgcttgtaaggcttcaccaggatccacctctgatgttcagtgaagaggaccggaaaagtctgctagagcagtgccatctgggtctggatcaaaaacgcagaaaatacgtggttggagagctcatctggaattttgccgatttcatgactaaccagtccaaggatgaaggaaaaactggacctcattatggatttacttttgggatacactcattattccagaggagggtaaaaggctgagaagcttaaggtatttcagtctgttttatgttactcatttgcgaaaagcaggctcatcgaatacaggtgagtttcaacgcgtcttgaatatggcagcatttaaaagtcttcagaccaggcatggtggctcatgcctgtcatcccagcactttgggaggccaaggtgggaggattgcttgaggccaggagttcgagaccagcctgttcagcatagcaggacccccatctctacaaaaactaaacagattagctaggtgtggtggtgtgtgcctgtagtcctagctgcttgggaggctgaggcaggcggatagcctgagcacaggagttggaggctgcagtaagccatgattacaccactgcacttgagcctgggcagcagagtgagacctgtctttaaaaaaaaaaaggagctgggcacggtggctcatgcctgtaatcccagcactttgggaggccgaggcaggcagatcacgaggtcaggagatcgagaccatcctggctaacagtgaaaccctgtctctactgaaaatacaaaaaaaatcagccgggcgtggtggcgggtgcctgtagtcccagctgctcgggaggctgaggcaggagaatggcatgaacccaggagttggagcttgcagtgagccgagattgtgccactgcactccagcctgggcgacagtgagactgcttctca

SEQ ID NO: 303330 - DNA, 183 bp, Homo sapiens
ctggagttgattcagctgcagctggccgcccagtttgagaattggtgtaagacatcacaatcccattattcagagcgcgtatggagtggaaacgcttgtaaggcttcaccaggtaagcggtgttgaactttctgcttgtgtattctctctgggcagagatgccacttgcctcccccaccctgc

SEQ ID NO: 303331 - DNA, 3416 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303332 - DNA, 847 bp, Homo sapiens
tcgcggaaggcgcgggagcttggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctatcactgcagatgacccgcgcgcacagaactgtcaactatgtaccagcagctctggagtccagcaccaaccctccagaaccaccgcccaacccgaagggcactgaccatccgcaggccccaccagcacgcccgcgccccgctgacgccca

SEQ ID NO: 303333 - DNA, 3201 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303334 - DNA, 3401 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtttgtgtgatgcagaacactaatcctgcccctccatttctttagtatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303335 - DNA, 3361 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303336 - DNA, 3377 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303337 - DNA, 3591 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaaaacaaacaagaaaaacaagaaaacaaaacaaagcaaaaaacagagcgcggtcgaccgcaagcaaaagcacccagcaaggtccacccaacacaacgcacccaccacacgcacgaaaacacaataggcgcccacaaggaaccaaaacaaaacgccagggccacccggcctaaaaaag

SEQ ID NO: 303338 - DNA, 3455 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaaaaaagtcgacgcggccgcgaatttagtagtagtagacga

SEQ ID NO: 303339 - DNA, 3945 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaaaaaaaaaaaaaaaaaaaaaaaaaaaaaaaaaaaaaaaaaaaaaaaaaaagaaacaaaatgacaaaaaataaaaaaaaataaacagagatcacacaaaaaaaagaggggcggcgcgcggtaagttgaataatattcttgaacgcgggcgacgctactttttttagtataccacagcgatgactttgttctacaaggaggcaggcggcgccttcataatgatagggtggtgatttatgtaataaagtagacccgcggcgctgttgttttataaaaaccacgctagttaggcagtgaatgaaacattgtggcactataccaccctaatttctgtgtggagcgcaccataccacttctatgtgttgcgcgaaccctccatattacatgtaaagcaactccccccgccataatagtaagattgccaatacgcgcgaatactattctaaatgtgccaaaaaatatgttaatattacacgacgtagtaaatatggtcgtaagagaaagattctttcgcagattatttataacgaca

SEQ ID NO: 303340 - DNA, 2977 bp, Homo sapiens
tcgcggaaggcgcgggagcttggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacggatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtttgtgtgatgcagaacactaatcctgcccctccatttctttagtatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303341 - DNA, 2564 bp, Homo sapiens
ctggtaaaggtgggtgcctgtaattgggcgccgccacagcttaaagtgtttcttatccatcaccatttcccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303342 - DNA, 2370 bp, Homo sapiens
  misc_feature (34)..(34): n is a, c, g, or t
  misc_feature (45)..(45): n is a, c, g, or t
actgctgtacttccagtgcaagataattcaatanctgatgtcccntttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303343 - DNA, 3406 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccagtccccaccacaaagttgtcagtaatacaggtcttattccttgagatagcacaaggcatatgtggcatcaagatcaatggaccccaagacagggagagagttttcatgagggaggggccctaagccattgtggagagacgtcccattagcatgtatgaggggccagcccttagtgcattcagggtaaggcccatggggagggatgccacccttgctcctttggaggacgtgccctcacccctcactggtccactggcttgagactcaccccgtgtgcccagtaaaagcctttgtgcagca

SEQ ID NO: 303344 - DNA, 2566 bp, Homo sapiens
cgcagctagtgggtgtgctttgagctgaactatatacagttatcgtagcaggaatctgtcagcatgttccatagccagaccagcggcgagctattgcacagacacagtagttgcctgcctcagtatacatcatgtcgagttcaagatgacaccggacaaggtgaccgttgcatacaatagagactgctgtgaccgttcgttaccagttgggttaacctgactagtgccttagtccaactgataactaccagctccattatagctggggtcgttcggtctgtacatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303345 - DNA, 2112 bp, Homo sapiens
  misc_feature (38)..(38): n is a, c, g, or t
gctcgactctcgaggatacaaccgcgagacgaccttgngttagttggatgtccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303346 - DNA, 1752 bp, Homo sapiens
cgagctcggtaccgggcactctaaatacatgcagaggcggtatggcatcttagtgaaatgggcggcagggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303347 - DNA, 1209 bp, Homo sapiens
taccccctggctctgaacttaggagatgagaatgagtcaacgacctgggacctgtgggttgaatgtctgctgaaagcagtaagaagagtatttaccaaggaaagacatgttattttggaggaactggaaggcagtattattattattattttgtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgttttgttttttttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303348 - DNA, 1070 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgaggtgagcccagtgtggctatcttttgggttccatagttgcacaggtgcatgggatttctgttcttcatacttctctaaactgttctggttgtttctcagaaaatttgccgtagttttttgtttattgtttttcttctcc

SEQ ID NO: 303349 - DNA, 555 bp, Homo sapiens
tgccaggttcaagcaattctcctgcttcagcctcccaagtagctgggattacagatgtgcaccaccacgcctagctaatttttgtatttttattagagacagggcttcaccatgttggccaggctggtctcgaactcctgacttcaagtgatccgcccgcctcggccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 303350 - DNA, 991 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagaggagatctattatgagatgaacggtggaagaaattcaatatgtttcgagctctgagtcagacacctcagaacaagcccaaagagggatgggattctggggacagcactggatggtggggtagaacctttacggggggccattgtggcccttcaacagtttggctccaatgaacccgggtttgttgggggagaataaaaaggcggttagggtgagaggtggcggcggtgaacacataagcaggttgggtggaaacatggttgtgagtaac

SEQ ID NO: 303351 - DNA, 856 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagggtgggcgctgcggcgagctctttctgggccgtggggtgggggggcttgtgaaccctggggcctgccctgtggtcgttggcccttgtttacccggtggtcttttaattggcaatacagtcgattgaacctgct

SEQ ID NO: 303352 - DNA, 877 bp, Homo sapiens
ggggccacagataggctaggtacgaggcctggtgttaatcggcacgagggcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctatcactgcagatgacccgcgcgcacagaactgtcaactatgtaccagcagctctggagtccagcaccaaccctccagaaccaccgcccaacccgaagggcactgaccatccgcaggccccaccagcacgcccgcgccccgctgacgccca

SEQ ID NO: 303353 - DNA, 352 bp, Homo sapiens
ggaaaacaacatgatggtgttggtgtcgcggtatgtatggctgcctgtggctgttgccgagttcctttagctgtggccttcattcctacgtacctgagtttgtatattcttagtgtcctatgagtctcccacaggcttccctgcagccagtgccccttccatccagctagaagatgagggactctgactgtctagaaagaatggagagatacaagcttttagttaaactgtttttttgggttctttaatgttggtaatcaaaagaagtgctgttgtttttgacccacagcctagtgagccgtaaattaccaaaggaactcacttcatttttaattaattcatttgtttgttg

SEQ ID NO: 303354 - DNA, 4366 bp, Homo sapiens
agcggagcagctgcagcgggtcgcacggctccggcccatctcggggggcgggcgggggaggcgaggtgcgcgagccgagtccggggcacgatgtccgacgcgggcggcggaaagaagccgcctgtggacccgcaggcaggacccggtccggggccggggcgcgcagctggggaaaggggcctgtcggggtccttccccctggtcctgaagaagctgatggagaaccccccgcgcgaggcgcgcctcgataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatgatcaaaaaggccaagaaggtctttgtccccgacgagcagaaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcagctcccgcaccccttttcccttatggctctgaggccatcggctgtctctgcatttcattggctgtggaggagagactcctaggatggctgctgtctgagccatgagtgccaggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccagggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaa

SEQ ID NO: 303355 - DNA, 4494 bp, Homo sapiens
agcggagcagctgcagcgggtcgcacggctccggcccatctcggggggcgggcgggggaggcgaggtgcgcgagccgagtccggggcacgatgtccgacgcgggcggcggaaagaagccgcctgtggacccgcaggcaggacccggtccggggccggggcgcgcagctggggaaaggggcctgtcggggtccttccccctggtcctgaagaagctgatggagaaccccccgcgcgaggcgcgcctcgataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatgatcaaaaaggccaagaaggtctttgtccccgacgagcagaaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcagctcccgcaccccttttcccttatggctctgaggccatcggctgtctctgcatttcattggctgtggaggagagactcctaggatggctgctgtctgagccatgagtgccaggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccagggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaaaaaaaaaaaaaaataaaaaaaaaaaacggggtttttttggggggggaaaggtttagagggcgggtctgtgttttcgcccccttttggaaggggaaatgggggcccaaaggggggtaaatgaaggggac

SEQ ID NO: 303356 - DNA, 3939 bp, Homo sapiens
cagtgaaccttaagtctgggtacatgtaaccctgctgaggggctgtgcaggccgctcctacggtcctttggcctgaggcagggcgggaggcatgcaagccagtgggggaaaacccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatgatcaaaaaggccaagaaggtctttgtccccgacgagcagaaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcagctcccgcaccccttttcccttatggctctgaggccatcggctgtctctgcatttcattggctgtggaggagagactcctaggatggctgctgtctgagccatgagtgccaggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccagggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaa

SEQ ID NO: 303357 - DNA, 3633 bp, Homo sapiens
  misc_feature (42)..(42): n is a, c, g, or t
  misc_feature (49)..(49): n is a, c, g, or t
caaaaaaaaacacaaaacaaaatatacggctaggtagagccnggggttnatcggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcagctcccgcaccccttttcccttatggctctgaggccatcggctgtctctgcatttcattggctgtggaggagagactcctaggatggctgctgtctgagccatgagtgccaggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccagggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaa

SEQ ID NO: 303358 - DNA, 3557 bp, Homo sapiens
agcggagcagctgcagcgggtcgcacggctccggcccatctcggggggcgggcgggggaggcgaggtgcgcgagccgagtccggggcacgatgtccgacgcgggcggcggaaagaagccgcctgtggacccgcaggcaggacccggtccggggccggggcgcgcagctggggaaaggggcctgtcggggtccttccccctggtcctgaagaagctgatggagaaccccccgcgcgaggcgcgcctcgataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatgatcaaaaaggccaagaaggtctttgtccccgacgagcagaaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcagctcccgcaccccttttcccttatggctctgaggccatcggctgtctctgcatttcattggctgtggaggagagactcctaggatggctgctgtctgagccatgagtgccaggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccagggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaa

SEQ ID NO: 303359 - DNA, 2743 bp, Homo sapiens
  misc_feature (42)..(42): n is a, c, g, or t
  misc_feature (49)..(49): n is a, c, g, or t
caaaaaaaaacacaaaacaaaatatacggctaggtagagccnggggttnatcgctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccagggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaaaaaaaaaaaaaaataaaaaaaaaaaacggggtttttttggggggggaaaggtttagagggcgggtctgtgttttcgcccccttttggaaggggaaatgggggcccaaaggggggtaaatgaaggggac

SEQ ID NO: 303360 - DNA, 2707 bp, Homo sapiens
tagtcaggaggccggcgtgtccatgtagatcaatggtccttgggctgacaacatctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccagggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaaaaaaaaaaaaaaataaaaaaaaaaaacggggtttttttggggggggaaaggtttagagggcgggtctgtgttttcgcccccttttggaaggggaaatgggggcccaaaggggggtaaatgaaggggac

SEQ ID NO: 303361 - DNA, 11072 bp, Homo sapiens
  misc_feature (3362)..(3362): n is a, c, g, or t
gagggaaggagggagggaagcagccgctgacccgtggcatgagctggatgcggtgtccgttgcaggactagggcgccgacatgaacctgcaccaggtgctgaccggggctgtgaaccctggcgaccactgcttctccgtgggcagcattggcgaccagcgcttcacggcttatgcatctggatgtgacattgtaatactgggaagcgattttgaaagattacagataatcccaggagctaaacatggaaatattcaagtgggatgtgtagactgttcaatgcaacaaggcaagattgcagcgtcttatggaaatgttatctccatttttgaaccagttaacctaccaaaacaaaagaaaaatttggaattatatagtcagtggcagaaaagtggccaattttttctggaatcaatagcacacaatataacctgggatcccacaggcagtcgtcttttaactggttccagctatttgcaactctggtccaatactaacttggagaagccaactgaagatgaaaatttaaataaaacagatcttaactttggagattggaaatgcatttggcattgcaaaactgcttcccaagttcatttaatgaaattttcaccagatggagaattttttgccactgctgggaaggatgactgtcttttgaaggtttggtataatgtagaaaactggcggacagctgttacttctccagatggaagttcagaaaaacaatcccaaggagaaattgacttttcttttgtgtatctggcccatcctcgagcagtaaatggattttcctggcgtaaaacaagcaaatatatgcctagggcttctgtatgtaatgtactgttgacttgctgcaaagataatgtgtgtcgtctttgggtagagacatttttaccaaatgattgtttgctatacggaggtgactgcagccattggactgaatcaattaatttaacaaataacttcaagagaaatgcttccagtaaagaacgagttcaaaatgctttagaagtaaatctgagacattttcgtagaggtcggaggagatcacttgctcttgtagcacatacgggatatctaccacatcagcaggatcctcatcatgttcacaggaacactccactgcatgccaatgcactttgccactttcatattgcagccagcatcaacccagccacagacattccacttcttccatctattacatctctgagtctaaatgaaaatgaagagaagaccggaccttttgttgtacactggctaaacaataaagaactgcattttactttgtccatggaagtttttttacagcaacttagaaaaagttttgaacaaccatcttctgaggccagtgtagaagattctaatcaggcagatgtaaaatctgatgaagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttcaggatcccagtgcagtttacagtgagcttattctgtggagggttgacccagttgggccattgtctttttctggaggagtttctgagcttgcccggattaattctcttcatgtttctgccttttccaatgtggcatggctgcccactcttatacccagttattgtctgggtgcatactgcaactctcctagtgcatgctttgtagccagtgatggacaatatctgagattatatgaagcagttattgatgctaagaaacttttatctgagctttctaaccctgaaatttctaaatatgttggtgaagtctttaacatcgtcagtcaacaatcaacagccaggccaggatgcattattgcattagatcccattaccaaacttcatggcagaaaaacccaactgcttcatgtttttgaagaagacttcattttgaataaccttgagaagaaaagccttggcaaagacagcattttatctaatgcaggcagctcacctaatggattttctgagaagttctacctaattgtaatagaatgcactcaagacaaccgttcactgttacacatgtggaatttacatctaaagtcaattcctgtctcattagatgaaaaagtagatacaaaattatccgaagcggtttggcagccagaagaacattattcttcttctccagagaagatcctatctcctttttcacaaaagtatcaggcttgcagagcaaatctccagagtaccagcaggttgactctgttttcagaaatggtttatagccaagaattgcatttaccagaaggagttgagataataagtattaagccatcagcaggacatctgagttcatcttctatatatcctgcatgcagtgctccttatttattggcaacttcatgttcagatgagaaagtaagattctggagatgcagagtaacagatggagaatctgccacgtcaaagaatggaaaaattgatcttgcatacatttgggaagaatggccattacttattgaagatggacttcagagcaatagtagtataactgtacctggtaggcctgtagaagttagctgtgcacatacaaatcgtttagcagtagcttataagcagcctgcatctaatagtagatcttcccaggactttgtgatgcatgtaagtatttttgaatgtgagtcaacaggaggttcatgttgggtccttgancagacaattcatttagatgagttaagcacagtattggattctggcattagtgttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtgtggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagcagatgatgatagctgttactcatctttggagaaatctagtaatgagagtacgttaagtaaatcaaaccaattatctaaagaaagttatgatgagctttttcagactcaacttctaatgactgatactcatatgttagagacagatgaagaaaatacaaagcctagagttattgacctttcacagtacagtccgacttactttggacctgagcatgctcaggttctttctggccacttacttcattctagtttaccaggactcagccggatggagcagatgtctttgatggccttagcagatacaattgcaactacaagcactgatattggagaaagccgagacagaagccaaggtggagaaactcttgatgaatgtgggttaaaatttcttttggctgttcgactccatacctttcttacaacttcccttccagcctatcgagctcaactccttcaccaaggcctgtctacaagtcattttgcttgggcatttcactcagtagcagaagaagaactgctgaacatgttgccagccatgcagaaagatgatcccacttggtctgaactaagagctatgggtgtggggtggtgggtccggaatacccgcatcttacgcaaatgcatagaaaaagtagctaaagcagccttttatagaaagaatgatcctttagatgctgccattttttaccttgcaatgaaaaagaaagctgtgatttggggattatatagagctgaaaaaaacaccaggatgacacagttttttggacacaattttgaggatgagaggtggcgtaaagcagctttaaagaatgctttttctttgctaggcaaacaaagatttgaacattctgcagcattttttcttttagctggttgcctcagagatgcaattgaggtatgtcttgagaaattgaatgacattcagttggctcttgtaatagcaagactctatgagtctgaatttgatacatctgcagcatataaatctattttacgtaaaaaagttttgggaatcgattctcctgtcagtgaactgtgttcattgaacataaatatgcatcatgatccttttcttcggagcatggcatattggattttggaagattatagtggtgctctggaaacattaataaagcaacctatcagagagaatgatgatcaagttttatcagccagtaatcctacagtttttaatttctacaattatctaagaacacatcctcttttgctgagacgtcattttggatcatctgatacattttccacacatatgagcctaacaggaaaaagtggactggcaggaacaattaatttaagtgaaagacgtttattttttaccactgccagtgctcatttaaaagctggctgcccaatgttggctttggaagtattatcaaagatgcctaaagtcatcaagaaaacaagacctttttatagggcttctagttttctggatactagtaaagactgttctccttcttctccattaaagttggatgcaagggaagataagtcttctgctgttgattggtcacagtcactgataaatggttttggatcttcttcagagggttcctcagagaagcaatcaaactccactctttcttttgactggagccaaccaagtgttgtgtttcaggatgactctttagagttaaaatgggacagtgataatgatgaagaaaatgaggatgtccctatttcaatgaaagaactaaaacctttacagagaaaaacagataaaaagttggatgacataagttctaactacacagaatctttcagcacactagatgaaaatgaccttttaaatccatcagaagatataattgcagttcagttaaaatttagagcatgtttaaagattctcacagtagaacttcgtactttatctactggctatgaaatagatggtggaaaattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaacaaaagtgaaacaactgagagaaaattttcaggaaaaaagacagtggctcttgaagtatcagtcacttttgagaatgtttcttagttactgcatacttcatggatcccatggtgggggtcttgcatctgtaagaatggaattgattttgcttttgcaagaatctcagcaggaaacatcagaaccactattttctagccttctgtcagagcaaacctcagtgcctctcctctttgcttgtacagccaatgccaaaacagtagttgccaatccattattgcaccttagtaatctgacacatgatattctccatgccataataaactttgattcaccaccccaccctgatatccaaagcaataaagtgtatgtaatgcatactttagcagcttcactttctgcttgtatttatcagtgcctttgtggtagtcataactacagttcatttcagacgaatcagtttactggaatggtatatcagacagtactgcttcctcatcgaccttctttgaaaacaggaagcttagatgaagcattaactcccaatacgtcaccagctcaatggccaggaataacttgtctaattcgacttttgaattcttctggcgaggaagcccagtcagggcttacagtcttgctctgtgagattctcacagcagtgtatcttagtctcttcatccatggcctggccacacattcaagtaatgagctatttcggattgtggcccatcctctaaatgagaaaatgtggtctgctgtgtttggtggaggtgcacatgttcctagcaaagaacagacacattcaaaaactttacctgtttcttcactagttgaagaaggagaaaaacagaacaaacgttttaggccgtcaaaaatgtcttgcagagaatctgccccactgaccccttcctcggcaccagtaagccaggagtcactggcggttaaagaaaagttcatcccacctgagctcagtatctgggactatttcatagctaagccttttctaccctcttctcaaagtagagccgaatatgattcagaggagagtctgggaagtgatgatgatgacaatgatgatgatgatgatgttttagcatcagatttccatctccaggaacattctaattcaaattcatatagttggtccttgatgcggttggcgatggtgcaattggtgctcaacaatttgaagactttttatcccttcgcaggtcatgatcttgcagagcttccagttagttcacctctttgtcatgcggttctaaaaactcttcaatgttgggaacaagttcttctccgacgacttgaaatccatggtgggccacctcaaaattatatcgcaagtcataccgccgaagagagtttgtctgcaggtcctgcaattcttcgccacaaagctttactggaacctacaaacactcctttcaaatccaaacaccatctggcactgtctgtgaagaggctttggcagtatttggtgaagcaggaagaaattcaggaaacctttatcaaaaatatattcacaaagaaacggtgtctaaatgagatagaagcagatttgggatatcctggaggtaaagcaagaattattcataaggaatctgatatcattactgcgtttgctgttaataaggcaaatagaaactgcatagcaatcgcttccagtcatgatgttcaagaactggatgtttctggaattctggccacacaggtctacacttgggtagatgatgatatagaagtggaaaccaaaggatcagaagatttcttggttatacatgctcgtgatgatttaacagctgttcaaggtacaactccatatacacatagcaatcctggcactccaatcaacatgccatggcttggtagtacacagactggcagaggagcatctgtgatgattaagaaagccattaataatgttagaagaatgacttctcatccaactcttccttactatctgacaggagctcaagatggaagtgtcagaatgtttgaatggggccattctcaacaaataacctgttttcgatctggtggcaattcaagagttacaagaatgagatttaactatcagggaaataagtttggaatagttgatgctgatggatatttaagtttgtatcaaacaaactggaaatgttgtccagttactggaagcatgcctaagccatacctgacttggcagtgtcataacaaaacagccaatgattttgtcttcgttagttcctcctctctgatagctacagctggtctttcaactgacaatagaaacgtatgtttgtgggatactcttgtagcacctgccaatagtttagtccatgcatttacctgccatgacagtggagccacagttttagcatatgctccaaaacatcagctactaatatcaggtggcagaaaaggttttacatatgtatttgacctttgtcaacgacaacagaggcagcttttccagagccatgattctcctgttaaagccgttgctgttgatccaactgaagagtactttgttacaggatctgccgaaggcaatataaagatttggagtctctctacctttggtcttctccatacttttgtcagtgaacatgctcggcagtccatttttagaaatattggaactggagtgatgcaaattgagacagggcctgcaaatcacattttctcctgtggagctgatggaacaatgaaaatgagaatactgccagatcagtttagccctttaaatgaagtgttgaaaaatgatgtgaaatttatgctataacatttttacaataagatgtacaatttattacctatatggaagtggccaacagatataatatacagtgatcattctctatgccacaaattagctaatgctttcttgtttttatatttattttatggagctttgcccttgatgcactgatgccttaaaaattaacaaggtcattcagaagtagattacattgcctaaagtagaatgtgtaagtaatgctgtaataatacatatcatagtatattataatcagtatgtcatagtgttaaaggtgttttgttttctttattgatacttttccacaggcatctctgcatgaatttcttccacagtaaaaatacgttttttgtaaaggcaattgtacataatactcatcacttaattcaccacactctcacttcctttattagccttatacatctcaaactcttctcttaattaatgataggtatttgagtaagaatgaaaaaaataatgaacatcttcattaaaattgtcattgagacgtcagtgataaatgagctagatggctcaatatgtaaggttttcagtagtttaccctccggaacccaagttatatgtatgtatacgtgtgtgtgtgtgtgtgtgtgtgtatcttacacatcttatttgaacttagttgtatatattagcgaaaactggtttttcatgtgtttttgtgccataacaactattgccaccagaataacttttttttgcaactgtgcttttcatttttaaaaaatttttgaattcccatcctaattttcaaataagtttcaaggagactatcaggattattattttaaagattagatttagtcaaataagtcttagcaggcaataaagtttctgtggtggcatatatcatgtaagacacttaaagtaagtttgtgaatttgtcaactttcgagcatcaaacaaatattttacttaaattttattttatcttatttttaggtgcttttaatctcaaaattctgaaaagcgaatagcagtgttttcagaaacaaatgtgaaagcagtcaaattaagtagatactatttagaaatgtaaaatactctccagatctaccattaatagaaaataaactaaaccttatattttatttttgccaaaatattttattataaaatatgaccaaaatatttaaaatgcacaatgcttttaacttaaatgtgctaaccctgtttctgtctgttttgtgctgtaccttttctgattcagaattatagaaaacttgataaatacttgattttaaccaatgagactacaggcagatgggactaagtgtttatgggacaattatgtactatttaacttaaatatattttgtttaataggaaatatataataatagcattttatgtaataaaatatgggcaacgattatcttggaaattaaagagtcaaagcaaagaaatgaagggctggtaaaatgaattttgtaatatcctcaggatacttttatcttaaaagtatgttgttaaagattttgtaaattgtatttcaacaattttaaatgtgttgagcaagttgcagtgcaaacactgtcattatgtagagagtttatatgcacataataacctgtacctataaatcgtgcaataaccatatgcgactattttgccatggagaaatctgacagcattgcaaacaatagtattgtttgatgtagttaaccttaagttatttttcagtaatttcttcacaaatcaagattcaaacagctttaaacacttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaacttt

SEQ ID NO: 303362 - DNA, 11707 bp, Homo sapiens
  misc_feature (3362)..(3362): n is a, c, g, or t
gagggaaggagggagggaagcagccgctgacccgtggcatgagctggatgcggtgtccgttgcaggactagggcgccgacatgaacctgcaccaggtgctgaccggggctgtgaaccctggcgaccactgcttctccgtgggcagcattggcgaccagcgcttcacggcttatgcatctggatgtgacattgtaatactgggaagcgattttgaaagattacagataatcccaggagctaaacatggaaatattcaagtgggatgtgtagactgttcaatgcaacaaggcaagattgcagcgtcttatggaaatgttatctccatttttgaaccagttaacctaccaaaacaaaagaaaaatttggaattatatagtcagtggcagaaaagtggccaattttttctggaatcaatagcacacaatataacctgggatcccacaggcagtcgtcttttaactggttccagctatttgcaactctggtccaatactaacttggagaagccaactgaagatgaaaatttaaataaaacagatcttaactttggagattggaaatgcatttggcattgcaaaactgcttcccaagttcatttaatgaaattttcaccagatggagaattttttgccactgctgggaaggatgactgtcttttgaaggtttggtataatgtagaaaactggcggacagctgttacttctccagatggaagttcagaaaaacaatcccaaggagaaattgacttttcttttgtgtatctggcccatcctcgagcagtaaatggattttcctggcgtaaaacaagcaaatatatgcctagggcttctgtatgtaatgtactgttgacttgctgcaaagataatgtgtgtcgtctttgggtagagacatttttaccaaatgattgtttgctatacggaggtgactgcagccattggactgaatcaattaatttaacaaataacttcaagagaaatgcttccagtaaagaacgagttcaaaatgctttagaagtaaatctgagacattttcgtagaggtcggaggagatcacttgctcttgtagcacatacgggatatctaccacatcagcaggatcctcatcatgttcacaggaacactccactgcatgccaatgcactttgccactttcatattgcagccagcatcaacccagccacagacattccacttcttccatctattacatctctgagtctaaatgaaaatgaagagaagaccggaccttttgttgtacactggctaaacaataaagaactgcattttactttgtccatggaagtttttttacagcaacttagaaaaagttttgaacaaccatcttctgaggccagtgtagaagattctaatcaggcagatgtaaaatctgatgaagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttcaggatcccagtgcagtttacagtgagcttattctgtggagggttgacccagttgggccattgtctttttctggaggagtttctgagcttgcccggattaattctcttcatgtttctgccttttccaatgtggcatggctgcccactcttatacccagttattgtctgggtgcatactgcaactctcctagtgcatgctttgtagccagtgatggacaatatctgagattatatgaagcagttattgatgctaagaaacttttatctgagctttctaaccctgaaatttctaaatatgttggtgaagtctttaacatcgtcagtcaacaatcaacagccaggccaggatgcattattgcattagatcccattaccaaacttcatggcagaaaaacccaactgcttcatgtttttgaagaagacttcattttgaataaccttgagaagaaaagccttggcaaagacagcattttatctaatgcaggcagctcacctaatggattttctgagaagttctacctaattgtaatagaatgcactcaagacaaccgttcactgttacacatgtggaatttacatctaaagtcaattcctgtctcattagatgaaaaagtagatacaaaattatccgaagcggtttggcagccagaagaacattattcttcttctccagagaagatcctatctcctttttcacaaaagtatcaggcttgcagagcaaatctccagagtaccagcaggttgactctgttttcagaaatggtttatagccaagaattgcatttaccagaaggagttgagataataagtattaagccatcagcaggacatctgagttcatcttctatatatcctgcatgcagtgctccttatttattggcaacttcatgttcagatgagaaagtaagattctggagatgcagagtaacagatggagaatctgccacgtcaaagaatggaaaaattgatcttgcatacatttgggaagaatggccattacttattgaagatggacttcagagcaatagtagtataactgtacctggtaggcctgtagaagttagctgtgcacatacaaatcgtttagcagtagcttataagcagcctgcatctaatagtagatcttcccaggactttgtgatgcatgtaagtatttttgaatgtgagtcaacaggaggttcatgttgggtccttgancagacaattcatttagatgagttaagcacagtattggattctggcattagtgttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtgtggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagcagatgatgatagctgttactcatctttggagaaatctagtaatgagagtacgttaagtaaatcaaaccaattatctaaagaaagttatgatgagctttttcagactcaacttctaatgactgatactcatatgttagagacagatgaagaaaatacaaagcctagagttattgacctttcacagtacagtccgacttactttggacctgagcatgctcaggttctttctggccacttacttcattctagtttaccaggactcagccggatggagcagatgtctttgatggccttagcagatacaattgcaactacaagcactgatattggagaaagccgagacagaagccaaggtggagaaactcttgatgaatgtgggttaaaatttcttttggctgttcgactccatacctttcttacaacttcccttccagcctatcgagctcaactccttcaccaaggcctgtctacaagtcattttgcttgggcatttcactcagtagcagaagaagaactgctgaacatgttgccagccatgcagaaagatgatcccacttggtctgaactaagagctatgggtgtggggtggtgggtccggaatacccgcatcttacgcaaatgcatagaaaaagtagctaaagcagccttttatagaaagaatgatcctttagatgctgccattttttaccttgcaatgaaaaagaaagctgtgatttggggattatatagagctgaaaaaaacaccaggatgacacagttttttggacacaattttgaggatgagaggtggcgtaaagcagctttaaagaatgctttttctttgctaggcaaacaaagatttgaacattctgcagcattttttcttttagctggttgcctcagagatgcaattgaggtatgtcttgagaaattgaatgacattcagttggctcttgtaatagcaagactctatgagtctgaatttgatacatctgcagcatataaatctattttacgtaaaaaagttttgggaatcgattctcctgtcagtgaactgtgttcattgaacataaatatgcatcatgatccttttcttcggagcatggcatattggattttggaagattatagtggtgctctggaaacattaataaagcaacctatcagagagaatgatgatcaagttttatcagccagtaatcctacagtttttaatttctacaattatctaagaacacatcctcttttgctgagacgtcattttggatcatctgatacattttccacacatatgagcctaacaggaaaaagtggactggcaggaacaattaatttaagtgaaagacgtttattttttaccactgccagtgctcatttaaaagctggctgcccaatgttggctttggaagtattatcaaagatgcctaaagtcatcaagaaaacaagacctttttatagggcttctagttttctggatactagtaaagactgttctccttcttctccattaaagttggatgcaagggaagataagtcttctgctgttgattggtcacagtcactgataaatggttttggatcttcttcagagggttcctcagagaagcaatcaaactccactctttcttttgactggagccaaccaagtgttgtgtttcaggatgactctttagagttaaaatgggacagtgataatgatgaagaaaatgaggatgtccctatttcaatgaaagaactaaaacctttacagagaaaaacagataaaaagttggatgacataagttctaactacacagaatctttcagcacactagatgaaaatgaccttttaaatccatcagaagatataattgcagttcagttaaaatttagagcatgtttaaagattctcacagtagaacttcgtactttatctactggctatgaaatagatggtggaaaattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaacaaaagtgaaacaactgagagaaaattttcaggaaaaaagacagtggctcttgaagtatcagtcacttttgagaatgtttcttagttactgcatacttcatggatcccatggtgggggtcttgcatctgtaagaatggaattgattttgcttttgcaagaatctcagcaggaaacatcagaaccactattttctagccttctgtcagagcaaacctcagtgcctctcctctttgcttgtacagccaatgccaaaacagtagttgccaatccattattgcaccttagtaatctgacacatgatattctccatgccataataaactttgattcaccaccccaccctgatatccaaagcaataaagtgtatgtaatgcatactttagcagcttcactttctgcttgtatttatcagtgcctttgtggtagtcataactacagttcatttcagacgaatcagtttactggaatggtatatcagacagtactgcttcctcatcgaccttctttgaaaacaggaagcttagatgaagcattaactcccaatacgtcaccagctcaatggccaggaataacttgtctaattcgacttttgaattcttctggcgaggaagcccagtcagggcttacagtcttgctctgtgagattctcacagcagtgtatcttagtctcttcatccatggcctggccacacattcaagtaatgagctatttcggattgtggcccatcctctaaatgagaaaatgtggtctgctgtgtttggtggaggtgcacatgttcctagcaaagaacagacacattcaaaaactttacctgtttcttcactagttgaagaaggagaaaaacagaacaaacgttttaggccgtcaaaaatgtcttgcagagaatctgccccactgaccccttcctcggcaccagtaagccaggagtcactggcggttaaagaaaagttcatcccacctgagctcagtatctgggactatttcatagctaagccttttctaccctcttctcaaagtagagccgaatatgattcagaggagagtctgggaagtgatgatgatgacaatgatgatgatgatgatgttttagcatcagatttccatctccaggaacattctaattcaaattcatatagttggtccttgatgcggttggcgatggtgcaattggtgctcaacaatttgaagactttttatcccttcgcaggtcatgatcttgcagagcttccagttagttcacctctttgtcatgcggttctaaaaactcttcaatgttgggaacaagttcttctccgacgacttgaaatccatggtgggccacctcaaaattatatcgcaagtcataccgccgaagagagtttgtctgcaggtcctgcaattcttcgccacaaagctttactggaacctacaaacactcctttcaaatccaaacaccatctggcactgtctgtgaagaggctttggcagtatttggtgaagcaggaagaaattcaggaaacctttatcaaaaatatattcacaaagaaacggtgtctaaatgagatagaagcagatttgggatatcctggaggtaaagcaagaattattcataaggaatctgatatcattactgcgtttgctgttaataaggcaaatagaaactgcatagcaatcgcttccagtcatgatgttcaagaactggatgtttctggaattctggccacacaggtctacacttgggtagatgatgatatagaagtggaaaccaaaggatcagaagatttcttggttatacatgctcgtgatgatttaacagctgttcaaggtacaactccatatacacatagcaatcctggcactccaatcaacatgccatggcttggtagtacacagactggcagaggagcatctgtgatgattaagaaagccattaataatgttagaagaatgacttctcatccaactcttccttactatctgacaggagctcaagatggaagtgtcagaatgtttgaatggggccattctcaacaaataacctgttttcgatctggtggcaattcaagagttacaagaatgagatttaactatcagggaaataagtttggaatagttgatgctgatggatatttaagtttgtatcaaacaaactggaaatgttgtccagttactggaagcatgcctaagccatacctgacttggcagtgtcataacaaaacagccaatgattttgtcttcgttagttcctcctctctgatagctacagctggtctttcaactgacaatagaaacgtatgtttgtgggatactcttgtagcacctgccaatagtttagtccatgcatttacctgccatgacagtggagccacagttttagcatatgctccaaaacatcagctactaatatcaggtggcagaaaaggttttacatatgtatttgacctttgtcaacgacaacagaggcagcttttccagagccatgattctcctgttaaagccgttgctgttgatccaactgaagagtactttgttacaggatctgccgaaggcaatataaagatttggagtctctctacctttggtcttctccatacttttgtcagtgaacatgctcggcagtccatttttagaaatattggaactggagtgatgcaaattgagacagggcctgcaaatcacattttctcctgtggagctgatggaacaatgaaaatgagaatactgccagatcagtttagccctttaaatgaagtgttgaaaaatgatgtgaaatttatgctataacatttttacaataagatgtacaatttattacctatatggaagtggccaacagatataatatacagtgatcattctctatgccacaaattagctaatgctttcttgtttttatatttattttatggagctttgcccttgatgcactgatgccttaaaaattaacaaggtcattcagaagtagattacattgcctaaagtagaatgtgtaagtaatgctgtaataatacatatcatagtatattataatcagtatgtcatagtgttaaaggtgttttgttttctttattgatacttttccacaggcatctctgcatgaatttcttccacagtaaaaatacgttttttgtaaaggcaattgtacataatactcatcacttaattcaccacactctcacttcctttattagccttatacatctcaaactcttctcttaattaatgataggtatttgagtaagaatgaaaaaaataatgaacatcttcattaaaattgtcattgagacgtcagtgataaatgagctagatggctcaatatgtaaggttttcagtagtttaccctccggaacccaagttatatgtatgtatacgtgtgtgtgtgtgtgtgtgtgtgtatcttacacatcttatttgaacttagttgtatatattagcgaaaactggtttttcatgtgtttttgtgccataacaactattgccaccagaataacttttttttgcaactgtgcttttcatttttaaaaaatttttgaattcccatcctaattttcaaataagtttcaaggagactatcaggattattattttaaagattagatttagtcaaataagtcttagcaggcaataaagtttctgtggtggcatatatcatgtaagacacttaaagtaagtttgtgaatttgtcaactttcgagcatcaaacaaatattttacttaaattttattttatcttatttttaggtgcttttaatctcaaaattctgaaaagcgaatagcagtgttttcagaaacaaatgtgaaagcagtcaaattaagtagatactatttagaaatgtaaaatactctccagatctaccattaatagaaaataaactaaaccttatattttatttttgccaaaatattttattataaaatatgaccaaaatatttaaaatgcacaatgcttttaacttaaatgtgctaaccctgtttctgtctgttttgtgctgtaccttttctgattcagaattatagaaaacttgataaatacttgattttaaccaatgagactacaggcagatgggactaagtgtttatgggacaattatgtactatttaacttaaatatattttgtttaataggaaatatataataatagcattttatgtaataaaatatgggcaacgattatcttggaaattaaagagtcaaagcaaagaaatgaagggctggtaaaatgaattttgtaatatcctcaggatacttttatcttaaaagtatgttgttaaagattttgtaaattgtatttcaacaattttaaatgtgttgagcaagttgcagtgcaaacactgtcattatgtagagagtttatatgcacataataacctgtacctataaatcgtgcaataaccatatgcgactattttgccatggagaaatctgacagcattgcaaacaatagtattgtttgatgtagttaaccttaagttatttttcagtaatttcttcacaaatcaagattcaaacagctttaaacacttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaactttaaaaaaaaaaaaaaaaaaaaaaaaaaaaaaaaaaaaaaaaaaaaaaaaaaaaaaaagagaggggggggggcgcgccaagaaaaaccccccgggggggcgcccgtgcgggcggcccccgttttggggaaggggggggcccgccaatagtgagggagcgatcctatctatattatcaccgcagaagaggccgagaacggcgccgcgcactagctactaaccaaaccacgctctccaacgcgtaggaacacaaaccagcggcccatcccacgagggaaaaccactgggcgaagcaagcgacaccccaatcactctcgtgcggcggggcggcgacccaataaatgagtaggacaccacccactacaccaacaaagagcattatttacaacgaggcctcagaaaggaggcgaaaatattaaagaaccttctaacaggcgcggcatacatgggggcgtgcttaacccacatagcgcatgacaactctgcggcgccggcggagccgaggaaaaaaactccgcgctaacacggcggcgactgcactctacgacgacacaattttaaccacacgggggcgccatcactataaacactaccacccccacccaacagcacccgcacaaccacgcccacaccaccac

SEQ ID NO: 303363 - DNA, 3026 bp, Homo sapiens
gagggaaggagggagggaagcagccgctgacccgtggcatgagctggatgcggtgtccgttgcaggactagggcgccgacatgaacctgcaccaggtgctgaccggggctgtgaaccctggcgaccactgcttctccgtgggcagcattggcgaccagcgcttcacggcttatgcatctggatgtgacattgtaatactgggaagcgattttgaaagattacagataatcccaggagctaaacatggaaatattcaagtgggatgtgtagactgttcaatgcaacaaggcaagattgcagcgtcttatggaaatgttatctccatttttgaaccagttaacctaccaaaacaaaagaaaaatttggaattatatagtcagtggcagaaaagtggccaattttttctggaatcaatagcacacaatataacctgggatcccacaggcagtcgtcttttaactggttccagctatttgcaactctggtccaatactaacttggagaagccaactgaagatgaaaatttaaataaaacagatcttaactttggagattggaaatgcatttggcattgcaaaactgcttcccaagttcatttaatgaaattttcaccagatggagaattttttgccactgctgggaaggatgactgtcttttgaaggtttggtataatgtagaaaactggcggacagctgttacttctccagatggaagttcagaaaaacaatcccaaggagaaattgacttttcttttgtgtatctggcccatcctcgagcagtaaatggattttcctggcgtaaaacaagcaaccatgattctcctgttaaagccgttgctgttgatccaactgaagagtactttgttacaggatctgccgaaggcaatataaagatttggagtctctctacctttggtcttctccatacttttgtcagtgaacatgctcggcagtccatttttagaaatattggaactggagtgatgcaaattgagacagggcctgcaaatcacattttctcctgtggagctgatggaacaatgaaaatgagaatactgccagatcagtttagccctttaaatgaagtgttgaaaaatgatgtgaaatttatgctataacatttttacaataagatgtacaatttattacctatatggaagtggccaacagatataatatacagtgatcattctctatgccacaaattagctaatgctttcttgtttttatatttattttatggagctttgcccttgatgcactgatgccttaaaaattaacaaggtcattcagaagtagattacattgcctaaagtagaatgtgtaagtaatgctgtaataatacatatcatagtatattataatcagtatgtcatagtgttaaaggtgttttgttttctttattgatacttttccacaggcatctctgcatgaatttcttccacagtaaaaatacgttttttgtaaaggcaattgtacataatactcatcacttaattcaccacactctcacttcctttattagccttatacatctcaaactcttctcttaattaatgataggtatttgagtaagaatgaaaaaaataatgaacatcttcattaaaattgtcattgagacgtcagtgataaatgagctagatggctcaatatgtaaggttttcagtagtttaccctccggaacccaagttatatgtatgtatacgtgtgtgtgtgtgtgtgtgtgtgtatcttacacatcttatttgaacttagttgtatatattagcgaaaactggtttttcatgtgtttttgtgccataacaactattgccaccagaataacttttttttgcaactgtgcttttcatttttaaaaaatttttgaattcccatcctaattttcaaataagtttcaaggagactatcaggattattattttaaagattagatttagtcaaataagtcttagcaggcaataaagtttctgtggtggcatatatcatgtaagacacttaaagtaagtttgtgaatttgtcaactttcgagcatcaaacaaatattttacttaaattttattttatcttatttttaggtgcttttaatctcaaaattctgaaaagcgaatagcagtgttttcagaaacaaatgtgaaagcagtcaaattaagtagatactatttagaaatgtaaaatactctccagatctaccattaatagaaaataaactaaaccttatattttatttttgccaaaatattttattataaaatatgaccaaaatatttaaaatgcacaatgcttttaacttaaatgtgctaaccctgtttctgtctgttttgtgctgtaccttttctgattcagaattatagaaaacttgataaatacttgattttaaccaatgagactacaggcagatgggactaagtgtttatgggacaattatgtactatttaacttaaatatattttgtttaataggaaatatataataatagcattttatgtaataaaatatgggcaacgattatcttggaaattaaagagtcaaagcaaagaaatgaagggctggtaaaatgaattttgtaatatcctcaggatacttttatcttaaaagtatgttgttaaagattttgtaaattgtatttcaacaattttaaatgtgttgagcaagttgcagtgcaaacactgtcattatgtagagagtttatatgcacataataacctgtacctataaatcgtgcaataaccatatgcgactattttgccatggagaaatctgacagcattgcaaacaatagtattgtttgatgtagttaaccttaagttatttttcagtaatttcttcacaaatcaagattcaaacagctttaaacacttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaacttt

SEQ ID NO: 303364 - DNA, 318 bp, Homo sapiens
ccactaatgacgtgactgttcttttcattatataaatctgtctttagagagaaaaaaagattaaaactgtggcatagtgtgactcactgctaatatgttgctttgtaacacttgggacattttcaagagatgtttgactttacaaagtttgtggctaaaacctcaagtttcttgtttatttcattactttagttcattacagtgttatctgtacacctgtatcacgtactcagtggtatggtattttcaacttagaattaaaacaagtttaagttttaggtagttggtcaatcttctaaaatagtttgtaaagttttt

SEQ ID NO: 303365 - DNA, 3359 bp, Homo sapiens
ccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaacagatgttgttattgtaaagaatggaagaagaatatgtggaacaggaggttgtttagccagcgcacctttacatcaaaacaaaagctattttgaattcaaaatccagtccacaggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctattttgttagttatacactaaattcacatcacccgtgattatttcagttcagagataagtgaatcctcttcatgaccctgagtctttgcctggttcttaagaatcactgtcctttagttaacgccctgtgacctgaaccaatcactctatacatctttagatacgttgtctgttttcaaatgagcatggcaaggatgcatacatttccctcctttatcaactagaaacagtacattgttcaggaaaacatgagtgttagaattagaaagagatccaaattgtagttttgctgctcatcctattttctcctctccaagtctcagattcccatttataaaaggagcaatcatactgacataagattctatgattaaataaggtaatacgtatataacaccttaataatcataggcacttgcgccaggcgcggtggctcacacctgtaatcccagcactttgggaggctgaggcgggaggatcacaaggtcaggagatcgagaccatcgtggctaacatggtgaaaccctggctctactaaaaaaatacaaaaaaaattagccaggtgtggtggcgggcgcctgtagttctagctactctggaggctgaggcaggagaatggcttgaacccgggagacggcgcttgcagtgagccgagattgccccactgcactccagcctaggcaacagagtgagactctgtctcaaaaaaaattaaaataaaataaaataaaaatcataggcacttagtaagtgtagtttcctggatggtaaagtatcagggaaagtggttttctttctttttttttttttctcgttttttttttgagacagagtctcaccttgtcacccaggctagagtgcagtggcacgatcttggctcactgcaacctctgcttcccaggtttaagcgattctcttgcctcagcctcccgagtaggtgggactacaggtgcccgccaccacgcccgtgtaatttttgtatttttagtagagatggggtttcaccatgttgtccaggctggtctcaaactcctgacctcatgatccacctccctcagcctcccaaagtgctggaattataggcgtaagccaccacacccagccagaaagtggttctcatgatgcttctcagaccggcaacatcagcatcactggaacttgttaaaaatggacactctcagaacccacaccagacccaccaaatcagtttgagaactgccattcagtagagaattatttgcctactgtaaattttctaaggatttatgatgggctatttttgacccataggctcagagaatcctgcaaaatccttttttattgtttattctgcagacaaaaatgtgacaatatgctttgaaaacatagatatacttgagtaacatttatttacataaatcccaaattctacctctgaaggtatatgaaatttaactatgtatgtattatgcattttgtctggctttctatcataattttaatttgtaaagaatgtgcttacttgggaaagcaaattaaagtgactactgtttgctatcgttaaaaaaaaaaaaaaaaaaaaaaaaaaaaaaaaaaaaaaaaaaaaaaaagagaaggggagaaggagaaaaaaaaagagtaggggaaagggaaaaaaaatataagggaaaaaatgggggggggacagggaccaaaggggggggggaaagggaggggcggggagttaaaggggg

SEQ ID NO: 303366 - DNA, 1647 bp, Homo sapiens
ccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaacagatgttgttattgtaaagaatggaagaagaatatgtggaacaggaggttgtttagccagcgcacctttacatcaaaacaaaagctattttgaattcaaaatccagtccacaggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcct

SEQ ID NO: 303367 - DNA, 1230 bp, Homo sapiens
ccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaacagatgttgttattgtaaagaatggaagaagaatatgtggaacaggaggttgtttagccagcgcacctttacatcaaaacaaaagctattttgaattcaaaatccagtccacaggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggat

SEQ ID NO: 303368 - DNA, 906 bp, Homo sapiens
ccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaacagatgttgttattgtaaagaatggaagaagaatatgtggaacaggaggttgtttagccagcgcacctttacatcaaaacaaaagctattttgaattcaaaatccagtccacaggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctata

SEQ ID NO: 303369 - DNA, 789 bp, Homo sapiens
ccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctata

SEQ ID NO: 303370 - DNA, 2698 bp, Homo sapiens
ccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaacagatgttgttattgtaaagaatggaagaagaatatgtggaacaggaggttgtttagccagcgcacctttacatcaaaacaaaagctattttgaattcaaaatccagtccacaggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctattttgttagttatacactaaattcacatcacccgtgattatttcagttcagagataagtgaatcctcttcatgaccctgagtctttgcctggttcttaagaatcactgtcctttagttaacgccctgtgacctgaaccaatcactctatacatctttagatacgttgtctgttttcaaatgagcatggcaaggatgcatacatttccctcctttatcaactagaaacagtacattgttcaggaaaacatgagtgttagaattagaaagagatccaaattgtagttttgtgcccgccaccacgcccgtgtaatttttgtatttttagtagagatggggtttcaccatgttgtccaggctggtctcaaactcctgacctcatgatccacctccctcagcctcccaaagtgctggaattataggcgtaagccaccacacccagccagaaagtggttctcatgatgcttctcagaccggcaacatcagcatcactggaacttgttaaaaatggacactctcagaacccacaccagacccaccaaatcagtttgagaactgccattcagtagagaattatttgcctactgtaaattttctaaggatttatgatgggctatttttgacccataggctcagagaatcctgcaaaatccttttttattgtttattctgcagacaaaaatgtgacaatatgctttgaaaacatagatatacttgagtaacatttatttacataaatcccaaattctacctctgaaggtatatgaaatttaactatgtatgtattatgcattttgtctggctttctatcataattttaatttgtaaagaatgtgcttacttgggaaagcaaattaaagtgactactgtttgctatcgttaaaaaaaaaaaaaaaaaaaaaaaaaaaaaaaaaaaaaaaaaaaaaaaagagaaggggagaaggagaaaaaaaaagagtaggggaaagggaaaaaaaatataagggaaaaaatgggggggggacagggaccaaaggggggggggaaagggaggggcggggagttaaaggggg

SEQ ID NO: 303371 - DNA, 3153 bp, Homo sapiens
ctcctgccctgactgtcggtcctgtctcttgagccccatcatttataggttgaatcctatattattggaagtaattttcctctcacctcctaaagtcgaaacaaggcagactgcagaagtctgaagtcgcacctcaggaacagatgttgttattgtaaagaatggaagaagaatatgtggaacaggaggttgtttagccagcgcacctttacatcaaaacaaaagctattttgaattcaaaatccagtccacaggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctattttgttagttatacactaaattcacatcacccgtgattatttcagttcagagataagtgaatcctcttcatgaccctgagtctttgcctggttcttaagaatcactgtcctttagttaacgccctgtgacctgaaccaatcactctatacatctttagatacgttgtctgttttcaaatgagcatggcaaggatgcatacatttccctcctttatcaactagaaacagtacattgttcaggaaaacatgagtgttagaattagaaagagatccaaattgtagttttgctgctcatcctattttctcctctccaagtctcagattcccatttataaaaggagcaatcatactgacataagattctatgattaaataaggtaatacgtatataacaccttaataatcataggcacttgcgccaggcgcggtggctcacacctgtaatcccagcactttgggaggctgaggcgggaggatcacaaggtcaggagatcgagaccatcgtggctaacatggtgaaaccctggctctactaaaaaaatacaaaaaaaattagccaggtgtggtggcgggcgcctgtagttctagctactctggaggctgaggcaggagaatggcttgaacccgggagacggcgcttgcagtgagccgagattgccccactgcactccagcctaggcaacagagtgagactctgtctcaaaaaaaattaaaataaaataaaataaaaatcataggcacttagtaagtgtagtttcctggatggtaaagtatcagggaaagtggttttctttctttttttttttttctcgttttttttttgagacagagtctcaccttgtcacccaggctagagtgcagtggcacgatcttggctcactgcaacctctgcttcccaggtttaagcgattctcttgcctcagcctcccgagtaggtgggactacaggtgcccgccaccacgcccgtgtaatttttgtatttttagtagagatggggtttcaccatgttgtccaggctggtctcaaactcctgacctcatgatccacctccctcagcctcccaaagtgctggaattataggcgtaagccaccacacccagccagaaagtggttctcatgatgcttctcagaccggcaacatcagcatcactggaacttgttaaaaatggacactctcagaacccacaccagacccaccaaatcagtttgagaactgccattcagtagagaattatttgcctactgtaaattttctaaggatttatgatgggctatttttgacccataggctcagagaatcctgcaaaatccttttttattgtttattctgcagacaaaaatgtgacaatatgctttgaaaacatagatatacttgagtaacatttatttacataaatcccaaattctacctctgaaggtatatgaaatttaactatgtatgtattatgcattttgtctggctttctatcataattttaatttgtaaagaatgtgcttacttgggaaagcaaattaaagtgactactgtttgctatcgttaaaaaaaaaaaaaaaaaaaaaaaaaaaaaaaaaaaaaaaaaaaaaaaagagaaggggagaaggagaaaaaaaaagagtaggggaaagggaaaaaaaatataagggaaaaaatgggggggggacagggaccaaaggggggggggaaagggaggggcggggagttaaaggggg

SEQ ID NO: 303372 - DNA, 3242 bp, Homo sapiens
ccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctattttgttagttatacactaaattcacatcacccgtgattatttcagttcagagataagtgaatcctcttcatgaccctgagtctttgcctggttcttaagaatcactgtcctttagttaacgccctgtgacctgaaccaatcactctatacatctttagatacgttgtctgttttcaaatgagcatggcaaggatgcatacatttccctcctttatcaactagaaacagtacattgttcaggaaaacatgagtgttagaattagaaagagatccaaattgtagttttgctgctcatcctattttctcctctccaagtctcagattcccatttataaaaggagcaatcatactgacataagattctatgattaaataaggtaatacgtatataacaccttaataatcataggcacttgcgccaggcgcggtggctcacacctgtaatcccagcactttgggaggctgaggcgggaggatcacaaggtcaggagatcgagaccatcgtggctaacatggtgaaaccctggctctactaaaaaaatacaaaaaaaattagccaggtgtggtggcgggcgcctgtagttctagctactctggaggctgaggcaggagaatggcttgaacccgggagacggcgcttgcagtgagccgagattgccccactgcactccagcctaggcaacagagtgagactctgtctcaaaaaaaattaaaataaaataaaataaaaatcataggcacttagtaagtgtagtttcctggatggtaaagtatcagggaaagtggttttctttctttttttttttttctcgttttttttttgagacagagtctcaccttgtcacccaggctagagtgcagtggcacgatcttggctcactgcaacctctgcttcccaggtttaagcgattctcttgcctcagcctcccgagtaggtgggactacaggtgcccgccaccacgcccgtgtaatttttgtatttttagtagagatggggtttcaccatgttgtccaggctggtctcaaactcctgacctcatgatccacctccctcagcctcccaaagtgctggaattataggcgtaagccaccacacccagccagaaagtggttctcatgatgcttctcagaccggcaacatcagcatcactggaacttgttaaaaatggacactctcagaacccacaccagacccaccaaatcagtttgagaactgccattcagtagagaattatttgcctactgtaaattttctaaggatttatgatgggctatttttgacccataggctcagagaatcctgcaaaatccttttttattgtttattctgcagacaaaaatgtgacaatatgctttgaaaacatagatatacttgagtaacatttatttacataaatcccaaattctacctctgaaggtatatgaaatttaactatgtatgtattatgcattttgtctggctttctatcataattttaatttgtaaagaatgtgcttacttgggaaagcaaattaaagtgactactgtttgctatcgttaaaaaaaaaaaaaaaaaaaaaaaaaaaaaaaaaaaaaaaaaaaaaaaagagaaggggagaaggagaaaaaaaaagagtaggggaaagggaaaaaaaatataagggaaaaaatgggggggggacagggaccaaaggggggggggaaagggaggggcggggagttaaaggggg

SEQ ID NO: 303373 - DNA, 3256 bp, Homo sapiens
ccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaacagatgttgttattgtaaagaatggaagaagaatatgtggaacaggaggttgtttagccagcgcacctttacatcaaaacaaaagctattttgaattcaaaatccagtccacaggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctattttgttagttatacactaaattcacatcacccgtgattatttcagttcagagataagtgaatcctcttcatgaccctgagtctttgcctggttcttaagaatcactgtcctttagttaacgccctgtgacctgaaccaatcactctatacatctttagatacgttgtctgttttcaaatgagcatggcaaggatgcatacatttccctcctttatcaactagaaacagtacattgttcaggaaaacatgagtgttagaattagaaagagatccaaattgtagttttgctgctcatcctattttctcctctccaagtctcagattcccatttataaaaggagcaatcatactgacataagattctatgattaaataaggtaatacgtatataacaccttaataatcataggcacttgcgccaggcgcggtggctcacacctgtaatcccagcactttgggaggctgaggcgggaggatcacaaggtcaggagatcgagaccatcgtggctaacatggtgaaaccctggctctactaaaaaaatacaaaaaaaattagccaggtgtggtggcgggcgcctgtagttctagctactctggaggctgaggcaggagaatggcttgaacccgggagacggcgcttgcagtgagccgagattgccccactgcactccagcctaggcaacagagtgagactctgtctcaaaaaaaattaaaataaaataaaataaaaatcataggcacttagtaagtgtagtttcctggatggtaaagtatcagggaaagtggttttctttctttttttttttttctcgttttttttttgagacagagtctcaccttgtcacccaggctagagtgcagtggcacgatcttggctcactgcaacctctgcttcccaggtttaagcgattctcttgcctcagcctcccgagtaggtgggactacaggtgcccgccaccacgcccgtgtaatttttgtatttttagtagagatggggtttcaccatgttgtccaggctggtctcaaactcctgacctcatgatccacctccctcagcctcccaaagtgctggaattataggcgtaagccaccacacccagccagaaagtggttctcatgatgcttctcagaccggcaacatcagcatcactggaacttgttaaaaatggacactctcagaacccacaccagacccaccaaatcagtttgagaactgccattcagtagagaattatttgcctactgtaaattttctaaggatttatgatgggctatttttgacccataggctcagagaatcctgcaaaatccttttttattgtttattctgcagacaaaaatgtgacaatatgctttgaaaacatagatatacttgagtaacatttatttacataaatcccaaattctacctctgaaggtatatgaaatttaactatgtatgtattatgcattttgtctggctttctatcataattttaatttgtaaagaatgtgcttacttgggaaagcaaattaaagtgactactgtttgctatcgttaaaaaaaaaaaaaaaaaaaaaaaaaaaaaaaaaaaaaaaaaaaaaaaagagaaggggagaaggagaaaaaaaaagagtaggggaaagggaaaaaaaatataagggaaaaaatgggggggggacagggaccaaaggggggggggaaagggaggggcggggagttaaaggggg

SEQ ID NO: 303374 - DNA, 2792 bp, Homo sapiens
  misc_feature (50)..(51): n is a, c, g, or t
atatattctctccaacttacactcttactttcacacactcgcacagcacnnaaccttgacggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctattttgttagttatacactaaattcacatcacccgtgattatttcagttcagagataagtgaatcctcttcatgaccctgagtctttgcctggttcttaagaatcactgtcctttagttaacgccctgtgacctgaaccaatcactctatacatctttagatacgttgtctgttttcaaatgagcatggcaaggatgcatacatttccctcctttatcaactagaaacagtacattgttcaggaaaacatgagtgttagaattagaaagagatccaaattgtagttttgctgctcatcctattttctcctctccaagtctcagattcccatttataaaaggagcaatcatactgacataagattctatgattaaataaggtaatacgtatataacaccttaataatcataggcacttgcgccaggcgcggtggctcacacctgtaatcccagcactttgggaggctgaggcgggaggatcacaaggtcaggagatcgagaccatcgtggctaacatggtgaaaccctggctctactaaaaaaatacaaaaaaaattagccaggtgtggtggcgggcgcctgtagttctagctactctggaggctgaggcaggagaatggcttgaacccgggagacggcgcttgcagtgagccgagattgccccactgcactccagcctaggcaacagagtgagactctgtctcaaaaaaaattaaaataaaataaaataaaaatcataggcacttagtaagtgtagtttcctggatggtaaagtatcagggaaagtggttttctttctttttttttttttctcgttttttttttgagacagagtctcaccttgtcacccaggctagagtgcagtggcacgatcttggctcactgcaacctctgcttcccaggtttaagcgattctcttgcctcagcctcccgagtaggtgggactacaggtgcccgccaccacgcccgtgtaatttttgtatttttagtagagatggggtttcaccatgttgtccaggctggtctcaaactcctgacctcatgatccacctccctcagcctcccaaagtgctggaattataggcgtaagccaccacacccagccagaaagtggttctcatgatgcttctcagaccggcaacatcagcatcactggaacttgttaaaaatggacactctcagaacccacaccagacccaccaaatcagtttgagaactgccattcagtagagaattatttgcctactgtaaattttctaaggatttatgatgggctatttttgacccataggctcagagaatcctgcaaaatccttttttattgtttattctgcagacaaaaatgtgacaatatgctttgaaaacatagatatacttgagtaacatttatttacataaatcccaaattctacctctgaaggtatatgaaatttaactatgtatgtattatgcattttgtctggctttctatcataattttaatttgtaaagaatgtgcttacttgggaaagcaaattaaagtgactactgtttgctatcgttaaaaaaaaaaaaaaaaaaaaaaaaaaaaaaaaaaaaaaaaaaaaaaaagagaaggggagaaggagaaaaaaaaagagtaggggaaagggaaaaaaaatataagggaaaaaatgggggggggacagggaccaaaggggggggggaaagggaggggcggggagttaaaggggg

SEQ ID NO: 303375 - DNA, 1076 bp, Homo sapiens
ccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaacagatgttgttattgtaaagaatggaagaagaatatgtggaacaggaggttgtttagccagcgcacctttacatcaaaacaaaagctattttgaattcaaaatccagtccacaggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctataaaaaaaaaaaaaaaaaaaaaaaaaaaaaaaaaaaaaaaaaaaaaaaagagaaggggagaaggagaaaaaaaaagagtaggggaaagggaaaaaaaatataagggaaaaaatgggggggggacagggaccaaaggggggggggaaagggaggggcggggagttaaaggggg

SEQ ID NO: 303376 - DNA, 313 bp, Homo sapiens
gaaaagaaaagaaaagaaaatacaaaactttacatagtgtctgcattttttgtttaggaacagatgttgttattgtaaagaatggaagaagaatatgtggaacaggaggttgtttagccagcgcacctttacatcaaaacaaaagctattttgaattcaaaatccagtccacaggttggtataatggtactttactattaaaagtcctaattgttctaaatattaagagtaatttgtaacacataaaaaagattcagaaggtaatataaaagcaccaaactcttagaagatctgggtcttccacctcttgttg

SEQ ID NO: 303377 - DNA, 766 bp, Homo sapiens
agcgggctcccatcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagggtgagagagcatgcgtggtgagccccaagcctccgcaagcaggggagtttggacctccccctgccacacacac

SEQ ID NO: 303378 - DNA, 444 bp, Homo sapiens
agcgggctcccatcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatgtaagtacccctgatatttctcgaggaaatagaaaacccgggtattgtctctaaaatctgcatcaatatattccacggcactgtgtctatctatccctgtgccttttttgaaggctgaagttgaggctcgttgtgcattctttttcgttaga

SEQ ID NO: 303379 - DNA, 219 bp, Homo sapiens
  misc_feature (208)..(208): n is a, c, g, or t
agcgggctcccatcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcctgctaagcagaaatgccacatttgcctaatccctgatanctgtggcacct

SEQ ID NO: 303380 - DNA, 6220 bp, Homo sapiens
agcgggctcccatcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaaccattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattgtgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 303381 - DNA, 6415 bp, Homo sapiens
  misc_feature (244)..(244): n is a, c, g, or t
  misc_feature (249)..(249): n is a, c, g, or t
aagatgcatggtgaaatggtgagatcagaaaggggccctgcatttgataaaaatgcaaaaaacaaaataaaaatagcatgaaagaaactagtatatacaatggatgtcagttgacccaatagattgctaatgtattaaaaacaatttagggtgttgcaatgtgatatgttctaaccccacaggttatccttttgacagctgaccttaaacttataaaatgtaagcagagtaaaagaaaacaganagaanatagttactcaaatgtgcaactgcacaaatatacccccctcccgctattaagataacaaaacttctgctattaccataatattatatatattagaaagctatacacaagcatgttaatttcacagatttttttaaaagattcttaatattttatataattagaaatacacacatttcaaaaacaaacttctacaaagagaaaacagttatcttggttagcaaagcatggagttcttcatggcttagggtagtgctttctatacacaaagtcctttttggttttttacaggactgtttaaaatattagcgacgctatcaaggaaaaaatacataatttcagggacgagaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaaccattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattgtgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 303382 - DNA, 6124 bp, Homo sapiens
agcgggctcccatcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaaccattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattgtgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 303383 - DNA, 6190 bp, Homo sapiens
agcgggctcccatcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaaccattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattgtgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 303384 - DNA, 6033 bp, Homo sapiens
aaagttatttttattcattttattgctttagctccatatagtttatttccttgataaaattagaatatgatagttcttatgaaactgacttgctgttagagtggtatttaatttttcttttttgttcagcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaaccattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattgtgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 303385 - DNA, 5884 bp, Homo sapiens
gctggtctcacctggtaacttgaacaagaatatgcaagcaaaatctcctcccccaatgaatttagaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaaccattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattgtgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 303386 - DNA, 6044 bp, Homo sapiens
ggaagatgctcccatatactttgacttgagatcatggatgttttgttgttgtagtctgttttttgtggtggagaaagccttcttgtctcattggggtattacaaatgcatgggaaatacaagtctgggctgctgcttgcttcttggcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaaccattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattgtgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 303387 - DNA, 5124 bp, Homo sapiens
tgaaggattgtaaatgatagggttggcagagttcatagagacacatgttaaatgattaatttcatgagatttgtaccaagttatctctttatgtggaaaactaatactgaaatctaatatttttaacttttaaaaaaattcatcagtaatgtctttttatttattttaaaagaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaaccattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattgtgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtga

SEQ ID NO: 303388 - DNA, 6254 bp, Homo sapiens
  misc_feature (5730)..(5730): n is a, c, g, or t
agcgggctcccatcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaaccattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattgtgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggggtattcctgcctaagacttgcacattgcggcccgggctcgttgaagtccaccccgagtataaggggctaaatgttcctgattggggccgcccatttactacatcctggggtaaagatggtggcggacccagtactcatagcaggcctctgtgtgtcgtttcttattatttttttgtacattcatatagtatgncgaaaaacacccactccaatcatatatcactcaacatacagggcgtccagatggacagaacacgagacaaagagagagagtagcagcagaagagaatcagcacgcaacgcgccagaactgggcaaagcagagacggaagcgagcagaagaggccagagcgagaggagaaggggggcgcgctgcgacgcggcacggagaaaggaaggaaacggggagacaaggctagcagcagcagagagacgaccgagcgacacccgaagagcagacacgcagtaagagccgacaacacggcgacggaggaccggcgctggcgatcacgctgcagcagaggggttccaggggcagcgacaaacaaaggagacaacacacctcaacaacaacgacaggtcgcaagacccaagcacgacacgcgcgagagacacacaacagccccaggacagagactaaccgcgaacactaaccgagagagacgcggcccagacacagcacgaaacaccaccaccaaacgacacaacacacaccac

SEQ ID NO: 303389 - DNA, 3826 bp, Homo sapiens
  misc_feature (244)..(244): n is a, c, g, or t
  misc_feature (249)..(249): n is a, c, g, or t
aagatgcatggtgaaatggtgagatcagaaaggggccctgcatttgataaaaatgcaaaaaacaaaataaaaatagcatgaaagaaactagtatatacaatggatgtcagttgacccaatagattgctaatgtattaaaaacaatttagggtgttgcaatgtgatatgttctaaccccacaggttatccttttgacagctgaccttaaacttataaaatgtaagcagagtaaaagaaaacaganagaanatagttactcaaatgtgcaactgcacaaatatacccccctcccgctattaagataacaaaacttctgctattaccataatattatatatattagaaagctatacacaagcatgttaatttcacagatttttttaaaagattcttaatattttatataattagaaatacacacatttcaaaaacaaacttctacaaagagaaaacagttatcttggttagcaaagcatggagttcttcatggcttagggtagtgctttctatacacaaagtcctttttggttttttacaggactgtttaaaatattagcgacgctatcaaggaaaaaatacataatttcagggacgagaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatccca

SEQ ID NO: 303390 - DNA, 2069 bp, Homo sapiens
  misc_feature (2036)..(2037): n is a, c, g, or t
agcgggctcccatcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttcttgataaagcccagttttcttcctgcctttttaataatgcattttgtagactctgagaatagaagagagagttcccggccaattttcgagtttcagcagaaacggggtttcgccatgttgcccaggctggtcttgaactcctgacctcaagcgatccacatgcttcggcctcccaaagtgctgggattacgggtgtgagccactgcacctgttcttctccganncgggcatgccggcggtcctcatgccgcccaca

SEQ ID NO: 303391 - DNA, 1539 bp, Homo sapiens
agcgggctcccatcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtggtaatacaaaactacattttaaataaatattgataatgttttgtatatgttttgctgtttttatatttgtctaacttgatgaattacttaacattctcccagaaaattaacataacagtgccattgacagagccttgcttgtatttagctattatttctggtaactggtttgcatttcccttttccgtgtaaaaaaaatatatatatatatctggtgaacttcactaggctgatgttctaggataagaaaaacattttcttttaaggctttcaatttatagttggaaaaaaatca

SEQ ID NO: 303392 - DNA, 811 bp, Homo sapiens
agcgggctcccatcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagcgacgtggggtcggacgggcgcttcctccgcgggtaccaccagtacgcctacgacggcaaggattacatcgccctgaaagaggacctgcgctcttggaccgcggcggacacgatgttca

SEQ ID NO: 303393 - DNA, 251 bp, Homo sapiens
gggttgtactttacaagtttatgactattgcaagaggacaaaatactgaggttgctgaaggtaaagtgttttgttctgtgggcctttagcctttctcgttttgatcttcctctttaatccataggtggtctgatgggtggagacctcacgtctggtgcaggcaccagtgcaggtaagcccagactccatactgcagtatgtatcattgttctgagttcttctactaggtgatttgcaggacaaagtctttt

SEQ ID NO: 303394 - DNA, 2285 bp, Homo sapiens
tcagctcctaaaatgcaggctgccaagaccctacacctgccctggctctacagccacttacctggtttctggactgtcaccctcccagctgacctgcccgtagccaaggaatgaggacctaacttgagttggcccaaagtctgacctggctgtatgtccctgtggcccacacccagcctgtcttgctcattcatgcagcctcaacactggcctccaaagttcccttaacacttgcaaagtcctttttacctgtgcatttggacttgaggacactggtttctatcacaggtgagagccatgttcaatacctccagcaagctctcctggctccctgcactgtgcacgctcctcttcccaaggtcccaataccagcacctctagttagagttagggtcagggtcaggcctctcccaacatcccagtagtttctcctctgagacacatgggcaagagacaatttggagtcaagattttccatttggatctattttaaatcttttagaaatgcatttgaaacagtgtgtttgttttttcccttctagttaagggactatttatatgtgtataggaaagctgtctctttttttgtttttcctttaacaaggtccaaagaaagatgcaaaaggagatcacacccttgccccgctgagccccgtgataacaagtcactccagactaacctgtgtgccagacatttgtgcattgttgcactttgaggttattatttatcaagttcttgaaggaagcagaaagagggactcctctctccctccgtgtatagtctctatgtttgtgctagtttttcttttttttctctgtgtccagtcagccacagggcccgcctccctgcaggaataaggggtaaaacgttaggtgttgtttggcaagaaaccacactgactgatgaggggtaaaatggaaccaggtagagccactccgggcagctgtcacccattcagaacttctttccgcagctgaagaaatgttcagtaacctgtttgacgctaattaaaacagagcctgcaggaagtggggctaaagtggcattcagtgatcctgttctgtagacttttctttctttttttaaccaaatccaaaggatgttacagaaaagctagccactggtattttgttttgtttaaaaaaaaaaagaaagaaagaaagaaagaaaaacggaaaggaacctagctgcctgtatctttcatttttaaaatagcacttgagttattttctgagtaatccaataaagaacttttgatgacagccagaatgtgttagaactctggctgaacatttcatctcctgtgagtcagaagggctttatttctccctttgatggggccccttcttctttctggtgctctggaagttgtttagaggaaagaattctaattttaattaattgcgcagtgagttaatctcactcgcttttctgcttccaggcatcttaggaaaaacaaatggttttagtagataagggatgcctactaatgcttttttaaaacaaacagggacatttttattatagatttgatttttttaatgaatgtttttaaaaatatataaataggacaccaaagcggcagggtttttttgggggggagggggtttgttttccaactcaagatggcacattagtggccagcaatattttttaactcattccaaccaggaagcttttttatacattgcctaaatctacgccaaccagaaaatagtctcatctctttttttctcaaatgagatccgtgttttattttagcattaaattagttacactgtgatgactggcctattacctgactcagctccctctaccttgaaattgacatttttaaaaaatgcaactaagtggttaatagtgtgtgacgctcaaagttaatgtaaactggaaaggttgtgtgtcgttgctttttgtgttttggttaggcttggttttgttttttaatttttatactttctaataaatttgcagtttcattcttgaaaaaaaaaaaaaaaaaaaaaaaaaaacatttttgggggggcttgggcctcggaaaaagtttttaacaccacttcgggtggggcggcggggcccacgtaggtacggcgaccacgcgggcccaaacgggaccccagaaggaaaccctggccaagaaaaaggtggcgagaattctccacaccagaaaaaaacgcgccgggggaaaccgcagagtgttgcgtaaaccacacccgaagagagaactcagaagcacacaagcgggactcaaccaggaggacccaagggaacccgatagagtacg

SEQ ID NO: 303395 - DNA, 2011 bp, Homo sapiens
tcagctcctaaaatgcaggctgccaagaccctacacctgccctggctctacagccacttacctggtttctggactgtcaccctcccagctgacctgcccgtagccaaggaatgaggacctaacttgagttggcccaaagtctgacctggctgtatgtccctgtggcccacacccagcctgtcttgctcattcatgcagcctcaacactggcctccaaagttcccttaacacttgcaaagtcctttttacctgtgcatttggacttgaggacactggtttctatcacaggtgagagccatgttcaatacctccagcaagctctcctggctccctgcactgtgcacgctcctcttcccaaggtcccaataccagcacctctagttagagttagggtcagggtcaggcctctcccaacatcccagtagtttctcctctgagacacatgggcaagagacaatttggagtcaagattttccatttggatctattttaaatcttttagaaatgcatttgaaacagtgtgtttgttttttcccttctagttaagggactatttatatgtgtataggaaagctgtctctttttttgtttttcctttaacaaggtccaaagaaagatgcaaaaggagatcacacccttgccccgctgagccccgtgataacaagtcactccagactaacctgtgtgccagacatttgtgcattgttgcactttgaggttattatttatcaagttcttgaaggaagcagaaagagggactcctctctccctccgtgtatagtctctatgtttgtgctagtttttcttttttttctctgtgtccagtcagccacagggcccgcctccctgcaggaataaggggtaaaacgttaggtgttgtttggcaagaaaccacactgactgatgaggggtaaaatggaaccaggtagagccactccgggcagctgtcacccattcagaacttctttccgcagctgaagaaatgttcagtaacctgtttgacgctaattaaaacagagcctgcaggaagtggggctaaagtggcattcagtgatcctgttctgtagacttttctttctttttttaaccaaatccaaaggatgttacagaaaagctagccactggtattttgttttgtttaaaaaaaaaaagaaagaaagaaagaaagaaaaacggaaaggaacctagctgcctgtatctttcatttttaaaatagcacttgagttattttctgagtaatccaataaagaacttttgatgacagccagaatgtgttagaactctggctgaacatttcatctcctgtgagtcagaagggctttatttctccctttgatggggccccttcttctttctggtgctctggaagttgtttagaggaaagaattctaattttaattaattgcgcagtgagttaatctcactcgcttttctgcttccaggcatcttaggaaaaacaaatggttttagtagataagggatgcctactaatgcttttttaaaacaaacagggacatttttattatagatttgatttttttaatgaatgtttttaaaaatatataaataggacaccaaagcggcagggtttttttgggggggagggggtttgttttccaactcaagatggcacattagtggccagcaatattttttaactcattccaaccaggaagcttttttatacattgcctaaatctacgccaaccagaaaatagtctcatctctttttttctcaaatgagatccgtgttttattttagcattaaattagttacactgtgatgactggcctattacctgactcagctccctctaccttgaaattgacatttttaaaaaatgcaactaagtggttaatagtgtgtgacgctcaaagttaatgtaaactggaaaggttgtgtgtcgttgctttttgtgttttggttaggcttggttttgttttttaatttttatactttctaataaatttgcagtttcattcttaaaaaaaagtcgacgcggccgcgaat

SEQ ID NO: 303396 - DNA, 1557 bp, Homo sapiens
cggacgcgtgggtcgacccacgcgtcgggactcctctctccctccgtgtatagtctctatgtttgtgctagtttttcttttttttctctgtgtccagtcagccacagggcccgcctccctgcaggaataaggggtaaaacgttaggtgttgtttggcaagaaaccacactgactgatgaggggtaaaatggaaccaggtagagccactccgggcagctgtcacccattcagaacttctttccgcagctgaagaaatgttcagtaacctgtttgacgctaattaaaacagagcctgcaggaagtggggctaaagtggcattcagtgatcctgttctgtagacttttctttctttttttaaccaaatccaaaggatgttacagaaaagctagccactggtattttgttttgtttaaaaaaaaaaagaaagaaagaaagaaagaaaaacggaaaggaacctagctgcctgtatctttcatttttaaaatagcacttgagttattttctgagtaatccaataaagaacttttgatgacagccagaatgtgttagaactctggctgaacatttcatctcctgtgagtcagaagggctttatttctccctttgatggggccccttcttctttctggtgctctggaagttgtttagaggaaagaattctaattttaattaattgcgcagtgagttaatctcactcgcttttctgcttccaggcatcttaggaaaaacaaatggttttagtagataagggatgcctactaatgcttttttaaaacaaacagggacatttttattatagatttgatttttttaatgaatgtttttaaaaatatataaataggacaccaaagcggcagggtttttttgggggggagggggtttgttttccaactcaagatggcacattagtggccagcaatattttttaactcattccaaccaggaagcttttttatacattgcctaaatctacgccaaccagaaaatagtctcatctctttttttctcaaatgagatccgtgttttattttagcattaaattagttacactgtgatgactggcctattacctgactcagctccctctaccttgaaattgacatttttaaaaaatgcaactaagtggttaatagtgtgtgacgctcaaagttaatgtaaactggaaaggttgtgtgtcgttgctttttgtgttttggttaggcttggttttgttttttaatttttatactttctaataaatttgcagtttcattcttgaaaaaaaaaaaaaaaaaaaaaaaaaaacatttttgggggggcttgggcctcggaaaaagtttttaacaccacttcgggtggggcggcggggcccacgtaggtacggcgaccacgcgggcccaaacgggaccccagaaggaaaccctggccaagaaaaaggtggcgagaattctccacaccagaaaaaaacgcgccgggggaaaccgcagagtgttgcgtaaaccacacccgaagagagaactcagaagcacacaagcgggactcaaccaggaggacccaagggaacccgatagagtacg

SEQ ID NO: 303397 - DNA, 1828 bp, Homo sapiens
tcagctcctaaaatgcaggctgccaagaccctacacctgccctggctctacagccacttacctggtttctggactgtcaccctcccagctgacctgcccgtagccaaggaatgaggacctaacttgagttggcccaaagtctgacctggctgtatgtccctgtggcccacacccagcctgtcttgctcattcatgcagcctcaacactggcctccaaagttcccttaacacttgcaaagtcctttttacctgtgcatttggacttgaggacactggtttctatcacaggtgagagccatgttcaatacctccagcaagctctcctggctccctgcactgtgcacgctcctcttcccaaggtcccaataccagcacctctagttagagttagggtcagggtcaggcctctcccaacatcccagtagtttctcctctgagacacatgggcaagagacaatttggagtcaagattttccatttggatctattttaaatcttttagaaatgcatttgaaacagtgtgtttgttttttcccttctagttaagggactatttatatgtgtataggaaagctgtctctttttttgtttttcctttaacaaggtccaaagaaagatgcaaaaggagatcacacccttgccccgctgagccccgtgataacaagtcactccagactaacctgtgtgccagacatttgtgcattgttgcactttgaggttattatttatcaagttcttgaaggaagcagaaagagggactcctctctccctccgtgtatagtctctatgtttgtgctagtttttcttttttttctctgtgtccagtcagccacagggcccgcctccctgcaggaataaggggtaaaacgttaggtgttgtttggcaagaaaccacactgactgatgaggggtaaaatggaaccaggtagagccactccgggcagctgtcacccattcagaacttctttccgcagctgaagaaatgttcagtaacctgtttgacgctaattaaaacagagcctgcaggaagtggggctaaagtggcattcagtgatcctgttctgtagacttttctttctttttttaaccaaatccaaaggatgttacagaaaagctagccactggtattttgttttgtttaaaaaaaaaaagaaagaaagaaagaaagaaaaacggaaaggaacctagctgcctgtatctttcatttttaaaatagcacttgagttattttctgagtaatccaataaagaacttttgatgacagccagaatgtgttagaactctggctgaacatttcatctcctgtgagtcagaagggctttatttctccctttgatggggccccttcttctttctggtgctctggaagttgtttagaggaaagaattctaattttaattaattgcgcagtgagttaatctcactcgcttttctgcttccaggcatcttaggaaaaacaaatggttttagtagataagggatgcctactaatgcttttttatacattgcctaaatctacgccaaccagaaaatagtctcatctctttttttctcaaatgagatccgtgttttattttagcattaaattagttacactgtgatgactggcctattacctgactcagctccctctaccttgaaattgacatttttaaaaaatgcaactaagtggttaatagtgtgtgacgctcaaagttaatgtaaactggaaaggttgtgtgtcgttgctttttgtgttttggttaggcttggttttgttttttaatttttatactttctaataaatttgcagtttcattcttaaaaaaaagtcgacgcggccgcgaat

SEQ ID NO: 303398 - DNA, 943 bp, Homo sapiens
cggacgcgtgggtcgacccacgcgtcgttgtttagaggaaagaattctaattttaattaattgcgcagtgagttaatctcactcgcttttctgcttccaggcatcttaggaaaaacaaatggttttagtagataagggatgcctactaatgcttttttaaaacaaacagggacatttttattatagatttgatttttttaatgaatgtttttaaaaatatataaataggacaccaaagcggcagggtttttttgggggggagggggtttgttttccaactcaagatggcacattagtggccagcaatattttttaactcattccaaccaggaagcttttttatacattgcctaaatctacgccaaccagaaaatagtctcatctctttttttctcaaatgagatccgtgttttattttagcattaaattagttacactgtgatgactggcctattacctgactcagctccctctaccttgaaattgacatttttaaaaaatgcaactaagtggttaatagtgtgtgacgctcaaagttaatgtaaactggaaaggttgtgtgtcgttgctttttgtgttttggttaggcttggttttgttttttaatttttatactttctaataaatttgcagtttcattcttgaaaaaaaaaaaaaaaaaaaaaaaaaaacatttttgggggggcttgggcctcggaaaaagtttttaacaccacttcgggtggggcggcggggcccacgtaggtacggcgaccacgcgggcccaaacgggaccccagaaggaaaccctggccaagaaaaaggtggcgagaattctccacaccagaaaaaaacgcgccgggggaaaccgcagagtgttgcgtaaaccacacccgaagagagaactcagaagcacacaagcgggactcaaccaggaggacccaagggaacccgatagagtacg

SEQ ID NO: 303399 - DNA, 2970 bp, Homo sapiens
aagagatgatttctccatcctgaacgtgcagcgagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcggaatcgtaaccaggtgtccgctggtgctgaaactgaaaaagcagccctgtgaggcatgggccggaaggatcagctaccggaacaccgagctagagcttcaggaccctggccaggtggagaaagagatacacaaagcccagaacgtcatggccgggaatggccggggcatcagccatgagctcatcagcctggagatcacctcccctgaggttccagacctgaccatcattgaccttcccggcatcaccagggtggctgtggacaaccagccccgagacatcggactgcagatcaaggctctcatcaagaagtacatccagaggcagcagacgatcaacttggtggtggttccctgtaacgtggacattgccaccacggaggcgctgagcatggcccatgaggtggacccggaaggggacaggaccatcggtatcctgaccaaaccagatctaatggacaggggcactgagaaaagcgtcatgaatgtggtgcggaacctcacgtaccccctcaagaagggctacatgattgtgaagtgccggggccagcaggagatcacaaacaggctgagcttggcagaggcaaccaagaaagaaattacattctttcaaacacatccatatttcagagttctcctggaggaggggtcagccacggttccccgactggcagaaagacttaccactgaactcatcatgcatatccaaaaatcgctcccgttgttagaaggacaaataagggagagccaccagaaggcgaccgaggagctgcggcgttgcggggctgacatccccagccaggaggccgacaagatgttctttctaattgagaaaatcaagatgtttaatcaggacatcgaaaagttagtagaaggagaagaagttgtaagggagaatgagacccgtttatacaacaaaatcagagaggattttaaaaactgggtaggcatacttgcaactaatacccaaaaagttaaaaatattatccacgaagaagttgaaaaatatgaaaagcagtatcgaggcaaggagcttctgggatttgtcaactacaagacatttgagatcatcgtgcatcagtacatccagcagctggtggagcccgcccttagcatgctccagaaagccatggaaattatccagcaagctttcattaacgtggccaaaaaacattttggcgaatttttcaaccttaaccaaactgttcagagcacgattgaagacataaaagtgaaacacacagcaaaggcagaaaacatgatccaacttcagttcagaatggagcagatggttttttgtcaagatcagatttacagtgttgttctgaagaaagtccgagaagagatttttaaccctctggggacgccttcacagaatatgaagttgaactctcattttcccagtaatgagtcttcggtttcctcctttactgaaataggcatccacctgaatgcctacttcttggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaactcttctgtcactatcagtgtccatctctactgtactccctcagcatcagagcatgcatcaggggtccacacaggctcagctctctccaccacccagctcttccctgaccttcacgaagggatggctctccagtccttgggtcccgtagcacacagttacagtgtcctaagatactgctatcattcttcgctaatttgtatttgtattcccttccccctacaagattatgagaccccagagggggaaggtctgggtcaaattcttcttttgtatgtccagtctcctgcacagcacctgcagcattgtaactgcttaataaatgacatctcactgaacgaatgagtgctgtgtaagtgatggagatacctgaggctattgctcaagcccaggccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatgagcttccattgttctgttaagtcttgaagaggaatttaataaagcaaagaaactttttaaaaacgtagccaggtt

SEQ ID NO: 303400 - DNA, 1548 bp, Homo sapiens
ccccacaagataggaatgaaatttcctttccctagattttgtgacccagtgaactttttggcctctgactgtctatccaatatgcaagtatcactgttcccaggaagaaaaaatagcttttaaactgcaaagacacccacctcccgaagccctttctcaatcagaatagagtggtttcccagccatgggcacctggctgccaggcatactggctatgcctatgaagaaggaatgaggggaggattcgaaacggccctggtgcatacccagaagggagccaggggagtcctgggctgggggagtttctccagcagggaggagctgtggggatgcccagaggtgatatgggcttgctagcctaccagggggcttcttagtgctagaggggatgcctggaagtaaagaggggtcagcgcaaatagaaccttcacggggcttgatgctgaccaccggagtggaggtgggcgagaccaccagggcttcgccaggcaaccatgtgcgcatccaggaactccatgccttctctctgcaaccacaggccttgggctgagaccactccagcaaacccttctttctccctcttccaggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaactcttctgtcactatcagtgtccatctctactgtactccctcagcatcagagcatgcatcaggggtccacacaggctcagctctctccaccacccagctcttccctgaccttcacgaagggatggctctccagtccttgggtcccgtagcacacagttacagtgtcctaagatactgctatcattcttcgctaatttgtatttgtattcccttccccctacaagattatgagaccccagagggggaaggtctgggtcaaattcttcttttgtatgtccagtctcctgcacagcacctgcagcattgtaactgcttaataaatgacatctcactgaacgaatgagtgctgtgtaagtgatggagatacctgaggctattgctcaagcccaggccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatgagcttccattgttctgttaagtcttgaagaggaatttaataaagcaaagaaactttttaaaaacgtagccaggtt

SEQ ID NO: 303401 - DNA, 1028 bp, Homo sapiens
ctagaggatcccccttatttgccttctttatggaaataggcatccacctgtaatgcctacttacttggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaactcttctgtcactatcagtgtccatctctactgtactccctcagcatcagagcatgcatcaggggtccacacaggctcagctctctccaccacccagctcttccctgaccttcacgaagggatggctctccagtccttgggtcccgtagcacacagttacagtgtcctaagatactgctatcattcttcgctaatttgtatttgtattcccttccccctacaagattatgagaccccagagggggaaggtctgggtcaaattcttcttttgtatgtccagtctcctgcacagcacctgcagcattgtaactgcttaataaatgacatctcactgaacgaatgagtgctgtgtaagtgatggagatacctgaggctattgctcaagcccaggccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatgagcttccattgttctgttaagtcttgaagaggaatttaataaagcaaagaaactttttaaaaacgtagccaggtt

SEQ ID NO: 303402 - DNA, 730 bp, Homo sapiens
aagaccttcaagttaattgttggaacctgcggctctaacacttccagcaaagctacttctgtgaaagctgtgacgagcagaggaaatgggacaggagaggagctgaatcctgagattgtatcgctaggagcccccaaagtacgatgacggtcctcgggccagcatgggggtgcattggcaccatgtaaggaaaggggccctcccgtggcaccgttggagtggggcggtgtggggttgttcggagagaaaagtttcccatgagctctgtttcagcaaacggcgatgaccacttccgtggcaactaaacagtcttgccttcctgcacgtggacatttttcttcatgcatatttctcttgcaaatggttctattgtttgtataacagtatttcatgagcggagaagagttggaagcaaaaatctgttcatgagaaatcctttattaagctcctactgtatgccaggtactttgggctgcaggtacagctgtgaaaaaaaacagcaggcgggaaccagccctgggacaggctccacacactcactgagcaccgcctcctgcacagcgcagtccctgctctcagcctgagcaggcgcagcagccctgccctcccaagaaaggggatggtgagaagcctagtgtcccctccacagagaccagcgccacacatgacagccacacatgacagtgttggtaccagcactcagtctttgagccacaagtgcttataagat

SEQ ID NO: 303403 - DNA, 3371 bp, Homo sapiens
aagaccttcaagttaattgttggaacctgcggctctaacacttccagcaaagctacttctgtgaaagctgtgacgagcagaggaaatgggacaggagaggagctgaatcctgagattgtatcgctaggagcccccaaagtacgatgacggtcctcgggccagcatgggggtgcattggcaccatgtaaggaaaggggccctcccgtggcaccgttggagtggggcggtgtggggttgttcggagagaaaagtttcccatgagctctgtttcagcaaacggcgatgaccacttccgtggcaactaaacagtcttgccttcctgcacgtggacatttttcttcatgcatatttctcttgcaaatggttctattgtttgtataacagtatttcatgagcggagaagagttggaagcaaaaatctgttcatgagaaatagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcggaatcgtaaccaggtgtccgctggtgctgaaactgaaaaagcagccctgtgaggcatgggccggaaggatcagctaccggaacaccgagctagagcttcaggaccctggccaggtggagaaagagatacacaaagcccagaacgtcatggccgggaatggccggggcatcagccatgagctcatcagcctggagatcacctcccctgaggttccagacctgaccatcattgaccttcccggcatcaccagggtggctgtggacaaccagccccgagacatcggactgcagatcaaggctctcatcaagaagtacatccagaggcagcagacgatcaacttggtggtggttccctgtaacgtggacattgccaccacggaggcgctgagcatggcccatgaggtggacccggaaggggacaggaccatcggtatcctgaccaaaccagatctaatggacaggggcactgagaaaagcgtcatgaatgtggtgcggaacctcacgtaccccctcaagaagggctacatgattgtgaagtgccggggccagcaggagatcacaaacaggctgagcttggcagaggcaaccaagaaagaaattacattctttcaaacacatccatatttcagagttctcctggaggaggggtcagccacggttccccgactggcagaaagacttaccactgaactcatcatgcatatccaaaaatcgctcccgttgttagaaggacaaataagggagagccaccagaaggcgaccgaggagctgcggcgttgcggggctgacatccccagccaggaggccgacaagatgttctttctaattgagaaaatcaagatgtttaatcaggacatcgaaaagttagtagaaggagaagaagttgtaagggagaatgagacccgtttatacaacaaaatcagagaggattttaaaaactgggtaggcatacttgcaactaatacccaaaaagttaaaaatattatccacgaagaagttgaaaaatatgaaaagcagtatcgaggcaaggagcttctgggatttgtcaactacaagacatttgagatcatcgtgcatcagtacatccagcagctggtggagcccgcccttagcatgctccagaaagccatggaaattatccagcaagctttcattaacgtggccaaaaaacattttggcgaatttttcaaccttaaccaaactgttcagagcacgattgaagacataaaagtgaaacacacagcaaaggcagaaaacatgatccaacttcagttcagaatggagcagatggttttttgtcaagatcagatttacagtgttgttctgaagaaagtccgagaagagatttttaaccctctggggacgccttcacagaatatgaagttgaactctcattttcccagtaatgagtcttcggtttcctcctttactgaaataggcatccacctgaatgcctacttcttggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaactcttctgtcactatcagtgtccatctctactgtactccctcagcatcagagcatgcatcaggggtccacacaggctcagctctctccaccacccagctcttccctgaccttcacgaagggatggctctccagtccttgggtcccgtagcacacagttacagtgtcctaagatactgctatcattcttcgctaatttgtatttgtattcccttccccctacaagattatgagaccccagagggggaaggtctgggtcaaattcttcttttgtatgtccagtctcctgcacagcacctgcagcattgtaactgcttaataaatgacatctcactgaacgaatgagtgctgtgtaagtgatggagatacctgaggctattgctcaagcccaggccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatgagcttccattgttctgttaagtcttgaagaggaatttaataaagcaaagaaactttttaaaaacgtagccaggtt

SEQ ID NO: 303404 - DNA, 2321 bp, Homo sapiens
aagaccttcaagttaattgttggaacctgcggctctaacacttccagcaaagctacttctgtgaaagctgtgacgagcagaggaaatgggacaggagaggagctgaatcctgagattgtatcgctaggagcccccaaagtacgatgacggtcctcgggccagcatgggggtgcattggcaccatgtaaggaaaggggccctcccgtggcaccgttggagtggggcggtgtggggttgttcggagagaaaagtttcccatgagctctgtttcagcaaacggcgatgaccacttccgtggcaactaaacagtcttgccttcctgcacgtggacatttttcttcatgcatatttctcttgcaaatggttctattgtttgtataacagtatttcatgagcggagaagagttggaagcaaaaatctgttcatgagaaatagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcggaatcgtaaccaggtgtccgctggtgctgaaactgaaaaagcagccctgtgaggcatgggccggaaggatcagctaccggaacaccgagctagagcttcaggaccctggccaggtggagaaagagatacacaaagcccagaacgtcatggccgggaatggccggggcatcagccatgagctcatcagcctggagatcacctcccctgaggttccagacctgaccatcattgaccttcccggcatcaccagggtggctgtggacaaccagccccgagacatcggactgcagatcaaggctctcatcaagaagtacatccagaggcagcagacgatcaacttggtggtggttccctgtaacgtggacattgccaccacggaggcgctgagcatggcccatgaggtggacccggaaggggacaggaccatcggtatcctgaccaaaccagatctaatggacaggggcactgagaaaagcgtcatgaatgtggtgcggaacctcacgtaccccctcaagaagggctacatgattgtgaagtgccggggccagcaggagatcacaaacaggctgagcttggcagaggcaaccaagaaagaaattacattctttcaaacacatccatatttcagagttctcctggaggaggggtcagccacggttccccgactggcagaaagacttaccactgaactcatcatgcatatccaaaaatcgctcccgttgttagaaggacaaataagggagagccaccagaaggcgaccgaggagctgcggcgttgcggggctgacatccccagccaggaggccgacaagatgttctttctaattgagaaaatcaagatgtttaatcaggacatcgaaaagttagtagaaggagaagaagttgtaagggagaatgagacccgtttatacaacaaaatcagagaggattttaaaaactgggtaggcatacttgcaactaatacccaaaaaggtaagttctgggcagggctccctgcaaaacagggtggtatttacccagaccagaggctatgtccagcacatgataagtgtgccaagagtggaacacgcccatccaagaccgtggaacccttggtaatcagcaactgtctctcaacgaacaaaacccagaaatatggggcgtcgacctcagcaactcaacacagggcaattccactgcctctgatgtcctcgtgtcttgattttgttttgttttgttgagacagggtctccctctgttgcctaggctggagtgtagtggcgcaatcatgactcactgcagcctcaacctcccaggctcaagtgatcctcccacctcagcctcctgagtagttgggaccacaggcatgaaccaccatacccagataatttttgt

SEQ ID NO: 303405 - DNA, 1169 bp, Homo sapiens
aagaccttcaagttaattgttggaacctgcggctctaacacttccagcaaagctacttctgtgaaagctgtgacgagcagaggaaatgggacaggagaggagctgaatcctgagattgtatcgctaggagcccccaaagtacgatgacggtcctcgggccagcatgggggtgcattggcaccatgtaaggaaaggggccctcccgtggcaccgttggagtggggcggtgtggggttgttcggagagaaaagtttcccatgagctctgtttcagcaaacggcgatgaccacttccgtggcaactaaacagtcttgccttcctgcacgtggacatttttcttcatgcatatttctcttgcaaatggttctattgtttgtataacagtatttcatgagcggagaagagttggaagcaaaaatctgttcatgagaaatagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcggaatcgtaaccaggtgtccgctggtgctgaaactgaaaaagcagccctgtgaggcatgggccggaaggatcagctaccggaacaccgagctagagcttcaggaccctggccaggtggagaaagagatacacaaagataaaatcaagtaggggaaaagatagggagcagacaaggaaagagggcagaggggggtgctctatcttctagtaaacccggggccgg

SEQ ID NO: 303406 - DNA, 385 bp, Homo sapiens
cctcgccacccctctccatgcttcggccacagtggcacatgccttcccttgctcacctcgaggccaccgcacatgcagtggcttcctgctggaatgcccttcacttccacccctcctcacctggccaactcctcattcaagactcaggtcagctgtcaactcctccaggagattttcttgggtgcccccaactaccccagggagatcaggtgtccccttttctgggatcctatagtacccctattacagcggttcccatctaaaggcaggtgtaatgggtagaatgacctccaatgacgccctcatcctaatctctggaacctgtgaacgtgctgttacaagacaaaggggagttaaggctaccaatggaattaagtttgctaat

SEQ ID NO: 303407 - DNA, 4767 bp, Homo sapiens
  misc_feature (37)..(37): n is a, c, g, or t
cggacggcgtgggcaacttgatacctctaatgaatcngctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaaggggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacagcctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaagcatttttctctcaaactgatggccaagaaatggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatagacagatcattggttctccatatctgatcatatgttactactttgaatcagtatttgggaaattcaagcatttatgcagtggatataaatggaaatataaaaatatttgccaacctgtctcagtaacttatcatatctctgtgatcctcaaggaaagcacttttgcttttacttagaaagcgtttcagatttgctttatagactcctgctgtcttcagtacctgataaaactttaaccagggaagcattaaacacagtgcagcagcttttgcccaggcttctaagttcctgccggcagcatttatcaatgtaagaactaggatgcttcctgcagtggcactaccttcccctagagctggagcatgctgcttggccttaagccccagcatgatgaggcttccctcctgccaggtcagtaaaagttagagagctcagaattgggtcttgcctgggtgcaggtggcagggtttgctgaaacccctaaagagaagtcaccaagggaggcaggtaatgaatgtttccagaatcagtcggatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggttttcccactgtgtgctgaccatcccaatttatgaatcttcttcaaaatgacatttcacagttatagttagggctcagaaatggcattgaggtagccttatttctcccctttagcagatgctttaagtacacattgctgacttgagcccacccccaggagttaggagaacatttcctttttcatgccatcttccataaataaggtgtttcttggccttcaaagatatagaactttgcagcagtagtaaaagtgaagggtgttctgctctctactcaactttatttgaaaatgtctgcagcttcactcctgtagaaaaggaaatcttcatattttagtaaacttagccgccagtgtactctgtgaggatgtggcaattcaaagtccagtgaatctggactctcttactgattcctggttttagtgtgtgtgtcgggggagtgtgtacctatatataaaggacaagtgtgatatgtgtgtatatgtatatacatacatacatgtccacacacacacacacaatatttgagagctaaggaaaactcaaagcagccccttcattatcttgcgtactacttcaaagatttctgtcagccctaattacaagtgtcaccatatagttggggcttaggtacttgcttacaggaagagcaattccctagcaaaggtcattagctcctaaggcactgagtcaaagtgacagccctgaaggaaattgcactccagccctcctccaggatgtctaataagatgggaaacttggatgcccagccattttggtgacctgagagtctaactactccagttagacctaagggcacaaatgcagaattcatgaccttgtagttgtggcagggtctaggaagtcctctctccccaagtagaaaatattctcttgccattcctgaaattccacattcatataatggctgtgcaatacatgcttctcaataagaaaattaactgcatgtttactgtgtgctgatcacatcagatttttatgtttaaaaaaatctcattatggattgagtccagcccagctctaagagaaaaagaaggcccatatgggagacttcagtctcattattattgcctttatccagcagtgcttatgaagccccctaccctgtcccattccagaaaccataagactcaggcagttcttgattctggaggcctgcctggtaagataagatagtataatttggaactgagaacataccagaaacagcagaacgagggccagagcagaaaaatgaaaataagtggagacacttatggatacattggtgcaaaaaaagccacggagcccatactgggcttgatatgactttgaggggacagcagattaatacttaatgagggttaaacctgaccagtctttctacagtgacaggccacactgcatgaatggggagaaccaatgaatccattgtcctctgcctattttcctgtgcacagtcacattccctccttaggaatcttccccttccaccctttacattaaacaagggaacactgaatctttcaagggaattacacgtttgggttaatgtttcagtatatcattttcatactgtaaattattttgtaagagagatttactgctatcccaggatgttcggacttggtgcccctgtgcatttggaaatcaataaactattactggaaatgc

SEQ ID NO: 303408 - DNA, 3747 bp, Homo sapiens
tctcccagcttcagatgtcagctctaatacattgtaaaaagctttaagatcttaaaaggtttccttttttcacatcaggattttctcatttaagttgatcaaacacttcctttccatagctgtccatagttccttctgcagtttcctacgtcactggttaagaatctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaagcatttttctctcaaactgatggccaagaaatggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatagacagatcattggttctccatatctgatcatatgttactactttgaatcagtatttgggaaattcaagcatttatgcagtggatataaatggaaatataaaaatatttgccaacctgtctcagtaacttatcatatctctgtgatcctcaaggaaagcacttttgcttttacttagaaagcgtttcagatttgctttatagactcctgctgtcttcagtacctgataaaactttaaccagggaagcattaaacacagtgcagcagcttttgcccaggcttctaagttcctgccggcagcatttatcaatgtaagaactaggatgcttcctgcagtggcactaccttcccctagagctggagcatgctgcttggccttaagccccagcatgatgaggcttccctcctgccaggtcagtaaaagttagagagctcagaattgggtcttgcctgggtgcaggtggcagggtttgctgaaacccctaaagagaagtcaccaagggaggcaggtaatgaatgtttccagaatcagtcggatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggttttcccactgtgtgctgaccatcccaatttatgaatcttcttcaaaatgacatttcacagttatagttagggctcagaaatggcattgaggtagccttatttctcccctttagcagatgctttaagtacacattgctgacttgagcccacccccaggagttaggagaacatttcctttttcatgccatcttccataaataaggtgtttcttggccttcaaagatatagaactttgcagcagtagtaaaagtgaagggtgttctgctctctactcaactttatttgaaaatgtctgcagcttcactcctgtagaaaaggaaatcttcatattttagtaaacttagccgccagtgtactctgtgaggatgtggcaattcaaagtccagtgaatctggactctcttactgattcctggttttagtgtgtgtgtcgggggagtgtgtacctatatataaaggacaagtgtgatatgtgtgtatatgtatatacatacatacatgtccacacacacacacacaatatttgagagctaaggaaaactcaaagcagccccttcattatcttgcgtactacttcaaagatttctgtcagccctaattacaagtgtcaccatatagttggggcttaggtacttgcttacaggaagagcaattccctagcaaaggtcattagctcctaaggcactgagtcaaagtgacagccctgaaggaaattgcactccagccctcctccaggatgtctaataagatgggaaacttggatgcccagccattttggtgacctgagagtctaactactccagttagacctaagggcacaaatgcagaattcatgaccttgtagttgtggcagggtctaggaagtcctctctccccaagtagaaaatattctcttgccattcctgaaattccacattcatataatggctgtgcaatacatgcttctcaataagaaaattaactgcatgtttactgtgtgctgatcacatcagatttttatgtttaaaaaaatctcattatggattgagtccagcccagctctaagagaaaaagaaggcccatatgggagacttcagtctcattattattgcctttatccagcagtgcttatgaagccccctaccctgtcccattccagaaaccataagactcaggcagttcttgattctggaggcctgcctggtaagataagatagtataatttggaactgagaacataccagaaacagcagaacgagggccagagcagaaaaatgaaaataagtggagacacttatggatacattggtgcaaaaaaagccacggagcccatactgggcttgatatgactttgaggggacagcagattaatacttaatgagggttaaacctgaccagtctttctacagtgacaggccacactgcatgaatggggagaaccaatgaatccattgtcctctgcctattttcctgtgcacagtcacattccctccttaggaatcttccccttccaccctttacattaaacaagggaacactgaatctttcaagggaattacacgtttgggttaatgtttcagtatatcattttcatactgtaaattattttgtaagagagatttactgctatcccaggatgttcggacttggtgcccctgtgcatttggaaatcaataaactattactggaaatgc

SEQ ID NO: 303409 - DNA, 4713 bp, Homo sapiens
  misc_feature (37)..(37): n is a, c, g, or t
cggacggcgtgggcaacttgatacctctaatgaatcngctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaaggggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacagcctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaagcatttttctctcaaactgatggccaagaaatggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatagacagatcattggttctccatatctgatcatatgttactactttgaatcagtatttgggaaattcaagcatttatgcagtggatataaatggaaatataaaaatatttgccaacctgtctcagtaacttatcatatctctgtgatcctcaaggaaagcacttttgcttttacttagaaagcgtttcagatttgctttatagactcctgctgtcttcagtacctgataaaactttaaccagggaagcattaaacacagtgcagcagcttttgcccaggcttctaagttcctgccggcagcatttatcaatgtaagaactaggatgcttcctgcagtggcactaccttcccctagagctggagcatgctgcttggccttaagccccagcatgatgaggcttccctcctgccaggtcagtaaaagttagagagctcagaattgggtcttgcctgggtgcaggtggcagggtttgctgaaacccctaaagagaagtcaccaagggaggcaggtaatgaatgtttccagaatcagtcggatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggttttcccactgtgtgctgaccatcccaatttatgaatcttcttcaaaatgacatttcacagttatagttagggctcagaaatggcattgaggtagccttatttctcccctttagcagatgctttaagtacacattgctgacttgagcccacccccaggagttaggagaacatttcctttttcatgccatcttccataaataaggtgtttcttggccttcaaagatatagaactttgcagcagtagtaaaagtgaagggtgttctgctctctactcaactttatttgaaaatgtctgcagcttcactcctgtagaaaaggaaatcttcatattttagtaaacttagccgccagtgtactctgtgaggatgtggcaattcaaagtccagtgaatctggactctcttactgattcctggttttagtgtgtgtgtcgggggagtgtgtacctatatataaaggacaagtgtgatatgtgtgtatatgtatatacatacatacatgtccacacacacacacacaatatttgagagctaaggaaaactcaaagcagccccttcattatcttgcgtactacttcaaagatttctgtcagccctaattacaagtgtcaccatatagttggggcttaggtacttgcttacaggaagagcaattccctagcaaaggtcattagctcctaaggcactgagtcaaagtgacagccctgaaggaaattgcactccagccctcctccaggatgtctaataagatgggaaacttggatgcccagccattttggtgacctgagagtctaactactccagttagacctaagggcacaaatgcagaattcatgaccttgtagttgtggcagggtctaggaagtcctctctccccaagtagaaaatattctcttgccattcctgaaattccacattcatataatggctgtgcaatacatgcttctcaataagaaaattaactgcatgtttactgtgtgctgatcacatcagatttttatgtttaaaaaaatctcattatggattgagtccagcccagctctaagagaagtgcttatgaagccccctaccctgtcccattccagaaaccataagactcaggcagttcttgattctggaggcctgcctggtaagataagatagtataatttggaactgagaacataccagaaacagcagaacgagggccagagcagaaaaatgaaaataagtggagacacttatggatacattggtgcaaaaaaagccacggagcccatactgggcttgatatgactttgaggggacagcagattaatacttaatgagggttaaacctgaccagtctttctacagtgacaggccacactgcatgaatggggagaaccaatgaatccattgtcctctgcctattttcctgtgcacagtcacattccctccttaggaatcttccccttccaccctttacattaaacaagggaacactgaatctttcaagggaattacacgtttgggttaatgtttcagtatatcattttcatactgtaaattattttgtaagagagatttactgctatcccaggatgttcggacttggtgcccctgtgcatttggaaatcaataaactattactggaaatgc

SEQ ID NO: 303410 - DNA, 3517 bp, Homo sapiens
cgggtgatctagaggatcccgtgtgtacgagataagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaagcatttttctctcaaactgatggccaagaaatggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatagacagatcattggttctccatatctgatcatatgttactactttgaatcagtatttgggaaattcaagcatttatgcagtggatataaatggaaatataaaaatatttgccaacctgtctcagtaacttatcatatctctgtgatcctcaaggaaagcacttttgcttttacttagaaagcgtttcagatttgctttatagactcctgctgtcttcagtacctgataaaactttaaccagggaagcattaaacacagtgcagcagcttttgcccaggcttctaagttcctgccggcagcatttatcaatgtaagaactaggatgcttcctgcagtggcactaccttcccctagagctggagcatgctgcttggccttaagccccagcatgatgaggcttccctcctgccaggtcagtaaaagttagagagctcagaattgggtcttgcctgggtgcaggtggcagggtttgctgaaacccctaaagagaagtcaccaagggaggcaggtaatgaatgtttccagaatcagtcggatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggttttcccactgtgtgctgaccatcccaatttatgaatcttcttcaaaatgacatttcacagttatagttagggctcagaaatggcattgaggtagccttatttctcccctttagcagatgctttaagtacacattgctgacttgagcccacccccaggagttaggagaacatttcctttttcatgccatcttccataaataaggtgtttcttggccttcaaagatatagaactttgcagcagtagtaaaagtgaagggtgttctgctctctactcaactttatttgaaaatgtctgcagcttcactcctgtagaaaaggaaatcttcatattttagtaaacttagccgccagtgtactctgtgaggatgtggcaattcaaagtccagtgaatctggactctcttactgattcctggttttagtgtgtgtgtcgggggagtgtgtacctatatataaaggacaagtgtgatatgtgtgtatatgtatatacatacatacatgtccacacacacacacacaatatttgagagctaaggaaaactcaaagcagccccttcattatcttgcgtactacttcaaagatttctgtcagccctaattacaagtgtcaccatatagttggggcttaggtacttgcttacaggaagagcaattccctagcaaaggtcattagctcctaaggcactgagtcaaagtgacagccctgaaggaaattgcactccagccctcctccaggatgtctaataagatgggaaacttggatgcccagccattttggtgacctgagagtctaactactccagttagacctaagggcacaaatgcagaattcatgaccttgtagttgtggcagggtctaggaagtcctctctccccaagtagaaaatattctcttgccattcctgaaattccacattcatataatggctgtgcaatacatgcttctcaataagaaaattaactgcatgtttactgtgtgctgatcacatcagatttttatgtttaaaaaaatctcattatggattgagtccagcccagctctaagagaaaaagaaggcccatatgggagacttcagtctcattattattgcctttatccagcagtgcttatgaagccccctaccctgtcccattccagaaaccataagactcaggcagttcttgattctggaggcctgcctggtaagataagatagtataatttggaactgagaacataccagaaacagcagaacgagggccagagcagaaaaatgaaaataagtggagacacttatggatacattggtgcaaaaaaagccacggagcccatactgggcttgatatgactttgaggggacagcagattaatacttaatgagggttaaacctgaccagtctttctacagtgacaggccacactgcatgaatggggagaaccaatgaatccattgtcctctgcctattttcctgtgcacagtcacattccctccttaggaatcttccccttccaccctttacattaaacaagggaacactgaatctttcaagggaattacacgtttgggttaatgtttcagtatatcattttcatactgtaaattattttgtaagagagatttactgctatcccaggatgttcggacttggtgcccctgtgcatttggaaatcaataaactattactggaaatgc

SEQ ID NO: 303411 - DNA, 4636 bp, Homo sapiens
  misc_feature (37)..(37): n is a, c, g, or t
cggacggcgtgggcaacttgatacctctaatgaatcngctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaaggggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacagcctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaagcatttttctctcaaactgatggccaagaaatggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatagacagatcattggttctccatatctgatcatatgttactactttgaatcagtatttgggaaattcaagcatttatgcagtggatataaatggaaatataaaaatatttgccaacctgtctcagtaacttatcatatctctgtgatcctcaaggaaagcacttttgcttttacttagaaagcgtttcagatttgctttatagactcctgctgtcttcagtacctgataaaactttaaccagggaagcattaaacacagtgcagcagcttttgcccaggcttctaagttcctgccggcagcatttatcaatgtaagaactaggatgcttcctgcagtggcactaccttcccctagagctggagcatgctgcttggccttaagccccagcatgatgaggcttccctcctgccaggtcagtaaaagttagagagctcagaattgggtcttgcctgggtgcaggtggcagggtttgctgaaacccctaaagagaagtcaccaagggaggcaggtaatgaatgtttccagaatcagtcggatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggttttcccactgtgtgctgaccatcccaatttatgaatcttcttcaaaatgacatttcacagttatagttagggctcagaaatggcattgaggtagccttatttctcccctttagcagatgctttaagtacacattgctgacttgagcccacccccaggagttaggagaacatttcctttttcatgccatcttccataaataaggtgtttcttggccttcaaagatatagaactttgcagcagtagtaaaagtgaagggtgttctgctctctactcaactttatttgaaaatgtctgcagcttcactcctgtagaaaaggaaatcttcatattttagtaaacttagccgccagtgtactctgtgaggatgtggcaattcaaagtccagtgaatctggactctcttactgattcctggttttagtgtgtgtgtcgggggagtgtgtacctatatataaaggacaagtgtgatatgtgtgtatatgtatatacatacatacatgtccacacacacacacacaatatttgagagctaaggaaaactcaaagcagccccttcattatcttgcgtactacttcaaagatttctgtcagcccctcctccaggatgtctaataagatgggaaacttggatgcccagccattttggtgacctgagagtctaactactccagttagacctaagggcacaaatgcagaattcatgaccttgtagttgtggcagggtctaggaagtcctctctccccaagtagaaaatattctcttgccattcctgaaattccacattcatataatggctgtgcaatacatgcttctcaataagaaaattaactgcatgtttactgtgtgctgatcacatcagatttttatgtttaaaaaaatctcattatggattgagtccagcccagctctaagagaaaaagaaggcccatatgggagacttcagtctcattattattgcctttatccagcagtgcttatgaagccccctaccctgtcccattccagaaaccataagactcaggcagttcttgattctggaggcctgcctggtaagataagatagtataatttggaactgagaacataccagaaacagcagaacgagggccagagcagaaaaatgaaaataagtggagacacttatggatacattggtgcaaaaaaagccacggagcccatactgggcttgatatgactttgaggggacagcagattaatacttaatgagggttaaacctgaccagtctttctacagtgacaggccacactgcatgaatggggagaaccaatgaatccattgtcctctgcctattttcctgtgcacagtcacattccctccttaggaatcttccccttccaccctttacattaaacaagggaacactgaatctttcaagggaattacacgtttgggttaatgtttcagtatatcattttcatactgtaaattattttgtaagagagatttactgctatcccaggatgttcggacttggtgcccctgtgcatttggaaatcaataaactattactggaaatgc

SEQ ID NO: 303412 - DNA, 2121 bp, Homo sapiens
  misc_feature (37)..(37): n is a, c, g, or t
cggacggcgtgggcaacttgatacctctaatgaatcngctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaaggggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacagcctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaaccggggggcccctaatgcgggggcgcgcgaaaacacggcgtaacggaaaggggcccaggggccaaaggcggtacctggacccaagtttttctgggtacaaggtgcgacaactcgcgcgcgtcccccataaggggaggcggatataaatccagataaggccagggtaaaccggataatgga

SEQ ID NO: 303413 - DNA, 228 bp, Homo sapiens
catttgtctctcagagttgtgcacaaaggaccctgcaaggtgtaaatatttatgacgagctgcatacttgactgtggtaatgctggagatgatggtgttttggttactagatgtgggagtctaatttactcctgacttttccacagtgccttaggagagagctctgggaagtggcaaaagaacagacttaagatcattattatttagtgataagttttctcctcaaag

SEQ ID NO: 303414 - DNA, 324 bp, Homo sapiens
tgtataccaggtactgtgcattttatatgtattctcttatttaatcctctagtaactcaagaaagtaagttttatcatcattccccctatggccagataaagaaatcagaatttagagaaacgaagtaacttgcctttggccatattgctcaatcatggtagttaagacttaattccaggtatgtctgacataaagtctgtgctatcaaccagtagactaggctgcctcccttcttgtgatatcttaactcacctggttctccttttcctttgtagtggtgccagtgaagaagaggacacatgaaggcttgctacccccagtgg

SEQ ID NO: 303415 - DNA, 4820 bp, Homo sapiens
  misc_feature (37)..(37): n is a, c, g, or t
cggacggcgtgggcaacttgatacctctaatgaatcngctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaaggggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacagcctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaagcatttttctctcaaactgatggccaagaaatggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatagacagatcattggttctccatatctgatcatatgttactactttgaatcagtatttgggaaattcaagcatttatgcagtggatataaatggaaatataaaaatatttgccaacctgtctcagtaacttatcatatctctgtgatcctcaaggaaagcacttttgcttttacttagaaagcgtttcagatttgctttatagactcctgctgtcttcagtacctgataaaactttaaccagggaagcattaaacacagtgcagcagcttttgcccaggcttctaagttcctgccggcagcatttatcaatgtaagaactaggatgcttcctgcagtggcactaccttcccctagagctggagcatgctgcttggccttaagccccagcatgatgaggcttccctcctgccaggtcagtaaaagttagagagctcagaattgggtcttgcctgggtgcaggtggcagggtttgctgaaacccctaaagagaagtcaccaagggaggcaggtaatgaatgtttccagaatcagtcggatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggttttcccactgtgtgctgaccatcccaatttatgaatcttcttcaaaatgacatttcacagttatagttagggctcagaaatggcattgaggtagccttatttctcccctttagcagatgctttaagtacacattgctgacttgagcccacccccaggagttaggagaacatttcctttttcatgccatcttccataaataaggtgtttcttggccttcaaagatatagaactttgcagcagtagtaaaagtgaagggtgttctgctctctactcaactttatttgaaaatgtctgcagcttcactcctgtagaaaaggaaatcttcatattttagtaaacttagccgccagtgtactctgtgaggatgtggcaattcaaagtccagtgaatctggactctcttactgattcctggttttagtgtgtgtgtcgggggagtgtgtacctatatataaaggacaagtgtgatatgtgtgtatatgtatatacatacatacatgtccacacacacacacacaatatttgagagctaaggaaaactcaaagcagccccttcattatcttgcgtactacttcaaagatttctgtcagccctaattacaagtgtcaccatatagttggggcttaggtacttgcttacaggaagagcaattccctagcaaaggtcattagctcctaaggcactgagtcaaagtgacagccctgaaggaaattgcactccagccctcctccaggatgtctaataagatgggaaacttggatgcccagccattttggtgacctgagagtctaactactccagttagacctaagggcacaaatgcagaattcatgaccttgtagttgtggcagggtctaggaagtcctctctccccaagtagaaaatattctcttgccattcctgaaattccacattcatataatggctgtgcaatacatgcttctcaataagaaaattaactgcatgtttactgtgtgctgatcacatcagatttttatgtttaaaaaaatctcattatggattgagtccagcccagctctaagagaaaaagaaggcccatatgggagacttcagtctcattattattgcctttatccagcagtgcttatgaagccccctaccctgtcccattccagaaaccataagactcaggcagttcttgattctggaggcctgcctggtaagataagatagtataatttggaactgagaacataccagaaacagcagaacgagggccagagcagaaaaatgaaaataagtggagacacttatggatacattggtgcaaaaaaagccacggagcccatactgggcttgatatgactttgaggggacagcagattaatacttaatgagggttaaacctgaccagtctttctacagtgacaggccacactgcatgaatggggagaaccaatgaatccattgtcctctgcctattttcctgtgcacagtcacattccctccttaggaatcttccccttccaccctttacattaaacaagggaacactgaatctttcaagggaattacacgtttgggttaatgtttcagtatatcattttcatactgtaaattattttgtaagagagatttactgctatcccaggatgttcggacttggtgcccctgtgcatttggaaatcaataaactattactggaaatgcaaaaaaaaagggggggaaaaaaacccaagggcaagatacgaccatctggaaag

SEQ ID NO: 303416 - DNA, 4396 bp, Homo sapiens
  misc_feature (37)..(37): n is a, c, g, or t
cggacggcgtgggcaacttgatacctctaatgaatcngctgagccaaaggcagagggcgatgaggaaggacccagtggtgccagtgaagaagaggacacatgaaggcttgctacccccagtggaaaatcatcccctccccttgtgtgtatgtgacagcgtgtatgtaacggcttctgatttctgtgaaagctgctcagcaacaaacgtacttccaccagatgtgtccccagatccacagcaggcacatatctctccaagggatgaccagttttatgcttactgtgtgcttctcatcccctggttgtggtaggtcaaggaaaagagcccctttgatccaccaggagcaattaagaaaggtccttcaggtaatccctcaatggctgctttgaacttactcaggaaagccagcccccataatattgtattaccaaacagtatcgctttgttaggaaggatctggaataatcttgaagggaagtcagagttttctccctgcctattaacaaaaacccaattttgttcatattgaagcatgaaataaatgagagcaaggtagggccaaattaactcttgtggacagtccctaaaagtccagttctacatttgtgaaaattgtggtgccatgaattaagatggatgactggaaaaaggtgttggagaaagagttaaagatgaggaagagatatttttagtatatgaagttatccaggacttgatattcataattcagtgctgtggaaatgaaaaaaatgattgaagaggtggaacggaaatgaccttagggggaaaaaaaaggaccaaagaagtctgattaaaagttgaaatcagtatttctgaattcaaattgcttgaatttccaaaatagtcagtaaaggatctaatagaaccagaattatttgggtgaattctgcaggttttatgggcttgtcacaacgtgaaggggctggaatgtatattaccaaatgggaatttccattgtaggtttttgctagtcccacccccattttagcctaatttggcttaaacgcagtatggggagaattgttcccattccatgtgttctgaattcagctcatctcccagcatatagatatatcctcctttaactccgaccagaacccttcttcctgtggcactccccacccatagaccttcagatcatctcccacagcctggatctcactctcctcttagtaacagagacactcctgaggttggacttccttgcttttctctacttccaaatcacaatttcttacaaccaagctttgtgctcccgagtaagcagggatgtactaggggaatgtaaaactgcaaacttaaaaacctgcatcttcttgaagcatcagttttacttaccaaatggtttagagtcataagatgacctatttttatataaaagttatattatagaataaaatgttcatacgcatagactgttaagataaaaaaataggaatcttgcaaggtaattcttatttgcaagtgggttatgtgttcactctcctctacctttatggtattttggtgttcacttacgaagcatacaactagaaccatatccaagcagactctgggttgctgttaacccagggcctagacttctagtgcctctgaggcagaaccaaaggagcctgcactgggggaaatcccttttcctgcctgcctgtctgcctgtgacctgtgtacgtattacaggctttaggaccagctgattgttatgcttgcaggatggttttgaaacagaaacaatacttgtttactgtaggaatcctatttatattatttttcagtcctgtgaatgctgtgaaaagatttattcctttgaggccaggaagctcccaggcatatatgcttctaggttaggattgtcctgactcactaaagatgccaggatattggggctgaggggagtttgaggtgttaaaaaaaaaaaaaaagcatttttctctcaaactgatggccaagaaatggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatagacagatcattggttctccatatctgatcatatgttactactttgaatcagtatttgggaaattcaagcatttatgcagtggatataaatggaaatataaaaatatttgccaacctgtctcagtaacttatcatatctctgtgatcctcaaggaaagcacttttgcttttacttagaaagcgtttcagatttgctttatagactcctgctgtcttcagtacctgataaaactttaaccagggaagcattaaacacagtgcagcagcttttgcccaggcttctaagttcctgccggcagcatttatcaatgtaagaactaggatgcttcctgcagtggcactaccttcccctagagctggagcatgctgcttggccttaagccccagcatgatgaggcttccctcctgccaggtcagtaaaagttagagagctcagaattgggtcttgcctgggtgcaggtggcagggtttgctgaaacccctaaagagaagtcaccaagggaggcaggtaatgaatgtttccagaatcagtcggatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggttttcccactgtgtgctgaccatcccaatttatgaatcttcttcaaaatgacatttcacagttatagttagggctcagaaatggcattgaggtagccttatttctcccctttagcagatgctttaagtacacattgctgacttgagcccacccccaggagttaggagaacatttcctttttcatgccatcttccataaataaggtgtttcttggccttcaaagatatagaactttgcagcagtagtaaaagtgaagggtgttctgctctctactcaactttatttgaaaatgtctgcagcttcactcctgtagaaaaggaaatcttcatattttagtaaacttagccgccagtgtactctgtgaggatgtggcaattcaaagtccagtgaatctggactctcttactgattcctggttttagtgtgtgtgtcgggggagtgtgtacctatatataaaggacaagtgtgatatgtgtgtatatgtatatacatacatacatgtccacacacacacacacaatatttgagagctaaggaaaactcaaagcagccccttcattatcttgcgtactacttcaaagatttctgtcagccctaattacaagtgtcaccatatagttggggcttaggtacttgcttacaggaagagcaattccctagcaaaggtcattagctcctaaggcactgagtcaaagtgacagccctgaaggaaattgcactccagccctcctccaggatgtctaataagatgggaaacttggatgcccagccattttggtgacctgagagtctaactactccagttagacctaagggcacaaatgcagaattcatgaccttgtagttgtggcagggtctaggaagtcctctctccccaagtagaaaatattctcttgccattcctgaaattccacattcatataatggctgtgcaatacatgcttctcaataagaaaattaactgcatgtttactgtgtgctgatcacatcagatttttatgtttaaaaaaatctcattatggattgagtccagcccagctctaagagaaaaagaaggcccatatgggagacttcagtctcattattattgcctttatccagcagtgcttatgaagccccctaccctgtcccattccagaaaccataagactcaggcagttcttgattctggaggcctgcctggtaagataagatagtataatttggaactgagaacataccagaaacagccacagccattaggtacaggcatttaggtaacagccatttaggtaacagccatttaggtaacagccatttagg

SEQ ID NO: 303417 - DNA, 2018 bp, Homo sapiens
tgcagggcggtaactgggggccagggtggcgccagggctggacagcacagtccctctgagctgcacggagacctcgcaggccccgagaactgtcgcccttccacgatgtggctccgtgctcttgtcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303418 - DNA, 1980 bp, Homo sapiens
tctttcttcatccccgcattcccaatatacccaggccacaagagccgagaactgtcgcccttccacgatgtggctccgtgctcttgtcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303419 - DNA, 2309 bp, Homo sapiens
tgcagggcggtaactgggggccagggtggcgccagggctggacagcacagtccctctgagctgcacggagacctcgcaggccccgagaactgtcgcccttccacgatgtggctccgtgctcttgtcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgaggtaggtctccggctggtacgtctctggctggacacccacacctccttggctctatgctcctgaatcctcagggatctctcttgtggttggttgtagctaatgttctcctagaatcactgaggcaccaatggctgagcaggaagggcgaggagacaccttgatcagcgtcccagtttcacagccaggcaaaccgacacagggcttggaagggatttgccaagggcagcaggtgatccgggcagagctgggactccagctcatggccctagcagccagtacagtgccctgtctgtgaccacactccacctatgtgccagggcctggtgccatgttgggcagtgatggtgtcttgtgtctctcagggtctgagttctgtggacccacttgtgggctgtgggcctgaagcagttccacactgagcgcctgataaccagggttggttcctggagaattcactcattgattcatttgttcacacaacaaaactaggtgactaagtgaaggcaaaaacaagaaatgggcagacgtcatcctttggctcaaagccagatgtccgtgtggaggggacatagacactgcatgggccctatgtggctctgcattctagtcagacatctaacacctccccaagcttcttgctataatgtaggaatagatgaatagctacagaatcacacaactagaaagtgtcacctatgacaagagcagtgaaggtgaggtacttgctgccacagcagaatctaaagaaagcattgagtcctggggctggacgaggttaccagggaaggcttgcttggaaaagtgactaatgagtcaggagcaaggaacgtccagggagtgggagcagcacatgcgcgtgctgtggcaggaggacgcatcccaatcgggagggagagacagagacagagccgatggggccagagcaggcagaacaggcggagcacggcgagtactgacagaggggacgttgggaggggccaccctgcacaggaccctggcaaggattttgtcatcatctggagagtggttgaaagccaaaggaagaggtgatcgataggaatccagacctaggctgaggatcgcccactggagccagtggcatggaggatttcggtagatttgaaagcttgtttggggaaagcatccaaatttaaagggccggtacataggaggagagaaaatggggatgccaagaatttttagaatttttgagaattttttaagaattcattggttataagcaacagttgcccattgaccagacttaagtcaagaaggagcattagcctggtgtggtggctcatgcctgtaatccctgcaatttgggagaccaaatgagaaggattgcttgagcccaggagtttgagaccagccagggcaacaaagtgataccctgtctctac

SEQ ID NO: 303420 - DNA, 1987 bp, Homo sapiens
tgcagggcggtaactgggggccagggtggcgccagggctggacagcacagtccctctgagctgcacggagacctcgcaggccccgagaactgtcgcccttccacgatgtggctccgtgctcttgtcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagatattactcgtataaccgggatactctagaacagactctgcagcctg

SEQ ID NO: 303421 - DNA, 1944 bp, Homo sapiens
aattggcctcaccatcactccccagggtaggaaggaccctacagacatcagagcagaccctgctcatctcagcagccaggtgttcggaggctttccagcagcccaccagtggccgccttcttttcttcccttttttaaaaaataatgtttactgtttttattttctgagtgcaaatgtaatatatacttattacagaaaatttaggaaatacagagaaaggaaagtaagaaaattaagatcacatacaatattccaccacccagagagaacaactatcagtattttagatggtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303422 - DNA, 1964 bp, Homo sapiens
tgcagggcggtaactgggggccagggtggcgccagggctggacagcacagtccctctgagctgcacggagacctcgcaggccccgagaactgtcgcccttccacgatgtggctccgtgctcttgtcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgacacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303423 - DNA, 1822 bp, Homo sapiens
tgcagggcggtaactgggggccagggtggcgccagggctggacagcacagtccctctgagctgcacggagacctcgcaggccccgagaactgtcgcccttccacgatgtggctccgtgctcttgtcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgactggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303424 - DNA, 922 bp, Homo sapiens
  misc_feature (8)..(8): n is a, c, g, or t
gtgcgagntgttctagagtatcccggtttagagtaatatctgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303425 - DNA, 911 bp, Homo sapiens
ttcttgagtacctggtacgaaatatattctgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303426 - DNA, 915 bp, Homo sapiens
cctgtgtatccctggttatacgagaatgtattctgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303427 - DNA, 884 bp, Homo sapiens
tggctgctcttgaggatcccagttacaagcaagagtagggctgcttgattccaagtgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303428 - DNA, 1645 bp, Homo sapiens
tgcagggcggtaactgggggccagggtggcgccagggctggacagcacagtccctctgagctgcacggagacctcgcaggccccgagaactgtcgcccttccacgatgtggctccgtgctcttgtcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303429 - DNA, 1971 bp, Homo sapiens
tgcagggcggtaactgggggccagggtggcgccagggctggacagcacagtccctctgagctgcacggagacctcgcaggccccgagaactgtcgcccttccacgatgtggctccgtgctcttgtcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagttctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303430 - DNA, 1886 bp, Homo sapiens
tgcagggcggtaactgggggccagggtggcgccagggctggacagcacagtccctctgagctgcacggagacctcgcaggccccgagaactgtcgcccttccacgatgtggctccgtgctcttgtcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303431 - DNA, 1918 bp, Homo sapiens
tgcagggcggtaactgggggccagggtggcgccagggctggacagcacagtccctctgagctgcacggagacctcgcaggccccgagaactgtcgcccttccacgatgtggctccgtgctcttgtcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303432 - DNA, 901 bp, Homo sapiens
acgggtctgtctcttgcgttaacagtgtttggacggaacagatccggggactctcttccagcctccgaccgcgctccgatgtcctgtccgcttgcgacctccaggagtttggatggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcactgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaa

SEQ ID NO: 303433 - DNA, 1483 bp, Homo sapiens
tgcagggcggtaactgggggccagggtggcgccagggctggacagcacagtccctctgagctgcacggagacctcgcaggccccgagaactgtcgcccttccacgatgtggctccgtgctcttgtcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgttgtaagagtctaggaatcatgggaattggctgagacccagagagggacaaggacttgcccaaatcatagagcaattaaatggcagaatgaagactggggcctcagggtttcccccatctttccacctttcccacttcattttccaccctagcggggagttgcacagggcttatggggttcaccattgaggcaggactttctggtgggct

SEQ ID NO: 303434 - DNA, 552 bp, Homo sapiens
gtggccgccttcttttcttcccttttttaaaaaataatgtttactgtttttattttctgagtgcaaatgtaatatatacttattacagaaaatttaggaaatacagagaaaggaaagtaagaaaattaagatcacatacaatattccaccacccagagagaacaactatcagtattttagatggtaaagtattatgatgtaatatattgtttgtattccagtttttttgcctgttgatatactttctttctttaaaagggaatgctatattgagataatttggatgcctgctttgctcatttataagtatatcatgagcataattccatgccattaaatagcacagcctggtattaaaagctgcattacattgggtattgaaccataattaatttccccaagcttttatttggggtcattaagttatatatgatgtttttaataatataacatcatgaatgtgaaacatttatgcacattcatgaatagtttaggataacttctcagaaatgacatttctgagtcaaagagtatatatttcttgtttgattt

SEQ ID NO: 303435 - DNA, 281 bp, Homo sapiens
gcggccgcctactactactactgctcgaattcaagcttctaacgatgtacggggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacaca

SEQ ID NO: 303436 - DNA, 6633 bp, Homo sapiens
atagggttcgtccgaccagcgtcgggcggtgcgtcgccatacgggttgcagccgcggcctccaggcggcacgcagctgtcagtgccgccgcaactgcgaggctggagcggatgcccgagtggccgagggaggggacccctgcgagagggcccgcgcgccggccgccgcgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagcccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacaca

SEQ ID NO: 303437 - DNA, 548 bp, Homo sapiens
ttattacatggttcaaatgcaaaagcctttgtccatccctttccctgaaggtaatgagtttctggtgtaagtttttatgtatatgtatacacacaacaaaatgttcgctggtcagggtcggcctcccgccaggagccctgcatctccctgcgtcccctgtcgttgcagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgcggcggtgggactggaggcagtgggttcccctcctgctcgacctgggactacaggcgcccgccaccactcctggctaattttttgtatttttagtagagatgggattttcaccgtgttatccaggatggtctcgatctgcctgaccttgtgatccacccacctcggcctcccaaagtgcgggcatggtggcacacacctgtaatctcagctacttgggagg

SEQ ID NO: 303438 - DNA, 598 bp, Homo sapiens
cagagtccaaacagtgctcagagtccaaacagtgcccagagtccaaacagtgcccagagtccaaacagtgcccagagtccaaacagtgcccagagtccaaacagtgcccaagttgggactctctggggctctccctgagtagcgccttctccacagcagtgcctcgaagtcctgggacagaggctgcatggctgtgtgcatctagtgtgtctgctggttgttgctttgctcgtcacaaacaaaacaaactgacagctgtctgcttccctcccagccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgccgcctcctgtggggacagggagggccggggctgccaggaccatgggaagacttaccagcacggcagtgagacctcatagcccgtcaggcgctccctctgagccttgctccctcctgccctgaaggagggcaggaaccctccgctgccctctaaccggttccccagggcacagacca

SEQ ID NO: 303439 - DNA, 632 bp, Homo sapiens
atagggttcgtccgaccagcgtcgggcggtgcgtcgccatacgggttgcagccgcggcctccaggcggcacgcagctgtcagtgccgccgcaactgcgaggctggagcggatgcccgagtggccgagggaggggacccctgcgagagggcccgcgcgccggccgccgcgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcactccagcctgggcgacagagtgagactccatctcaa

SEQ ID NO: 303440 - DNA, 6512 bp, Homo sapiens
atagggttcgtccgaccagcgtcgggcggtgcgtcgccatacgggttgcagccgcggcctccaggcggcacgcagctgtcagtgccgccgcaactgcgaggctggagcggatgcccgagtggccgagggaggggacccctgcgagagggcccgcgcgccggccgccgcgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagcccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacaca

SEQ ID NO: 303441 - DNA, 5470 bp, Homo sapiens
gggcctgtgttcaacgcaactggtacggcggcgttgggccaacgcccgtacatgtggacccaaacaggctcctttttcctgaaagagacagaaggctggcacactacttcccttttcccgcttttcccaaacccaggaccaagggaacctacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagcccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacaca

SEQ ID NO: 303442 - DNA, 5495 bp, Homo sapiens
atagggttcgtccgaccagcgtcgggcggtgcgtcgccatacgggttgcagccgcggcctccaggcggcacgcagctgtcagtgccgccgcaactgcgaggctggagcggatgcccgagtggccgagggaggggacccctgcgagagggcccgcgcgccggccgccgcgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttgtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacaca

SEQ ID NO: 303443 - DNA, 1293 bp, Homo sapiens
cagtgagctatgattgtgccactgcactccagcctgggctacagagcaagactctctctaaaaaaatatgggggaaaaaaagaactggctcagaaagggaacatcactggctcaaggttgtaatctgagctgggaacagcacagggaggaggctgggccccatccccgctggctcctgcttagccagcgtcctctacctgggagcacggtgccgtcgcagggctgacctctctggggctctggggtggcgctgggcaggggtaggattgtgggggcctcatcagcccctattgccagaggactcccaggtcccgcagaggagcctgggccctgttctctcctaccagtgacttttctgctccccaaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacaca

SEQ ID NO: 303444 - DNA, 5490 bp, Homo sapiens
  misc_feature (5462)..(5462): n is a, c, g, or t
  misc_feature (5486)..(5486): n is a, c, g, or t
atagggttcgtccgaccagcgtcgggcggtgcgtcgccatacgggttgcagccgcggcctccaggcggcacgcagctgtcagtgccgccgcaactgcgaggctggagcggatgcccgagtggccgagggaggggacccctgcgagagggcccgcgcgccggccgccgcgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagcccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccaaaagcatggggagggagttttnagggccctggttgcaacccggggntggg

SEQ ID NO: 303445 - DNA, 1225 bp, Homo sapiens
atagggttcgtccgaccagcgtcgggcggtgcgtcgccatacgggttgcagccgcggcctccaggcggcacgcagctgtcagtgccgccgcaactgcgaggctggagcggatgcccgagtggccgagggaggggacccctgcgagagggcccgcgcgccggccgccgcgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggtgttggatgcagtctggccttggggaagtgacctgtgctctctgtgcctcagtttccccatctgtgaaatggggacaataatggaacccacttcaaagggctgttatgggaatacactgggtggctgcctgcagagtgctgggaatgcggcgttggatgcagtcgggtaccgag

SEQ ID NO: 303446 - DNA, 235 bp, Homo sapiens
ccctagaggatttgccgtctttcatctgccagtgacctgaaccacgcagatttttcaagcaggagggccgattgggcaaccacagctcccgtgctctctctttgcagtgcgcggctttccctccgagaaggactttgaggactacattaggtacgacaactgctcgtccagcgtgctggccgccgtggtcttcgagcaccccttcaaccacagcaaggagcccctgccgctggcg

SEQ ID NO: 303447 - DNA, 3445 bp, Homo sapiens
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttccca

SEQ ID NO: 303448 - DNA, 881 bp, Homo sapiens
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccttgtacccgtacaaggccccgcgcgcacaaccacagccaggagcagcccctgccaccactgggccaccgtacaaggccccgcaggaccagccgaaggtgccccgggccgaggccagctgggtcaggtgtacccctagcctggggttgagtgaggagcggcacccccgtat

SEQ ID NO: 303449 - DNA, 588 bp, Homo sapiens
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttatcacatggtgatcgcggaagttaatttgatgcctccccacactcatgttccgaagtgccgttgctgcatcaataaatctgttgatttgctgcca

SEQ ID NO: 303450 - DNA, 3759 bp, Homo sapiens
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttccca

SEQ ID NO: 303451 - DNA, 3541 bp, Homo sapiens
ccccgttagtgataaatgaacacatgctgtggggaaaccgttcagctcgtgacgaagagaatgctagctcggcagttcattaccagtctgaacgagtaagatgaggaagctgatactcggagagattaagtgattcgcctccaagggtcccctagccacaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttccca

SEQ ID NO: 303452 - DNA, 3706 bp, Homo sapiens
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttccca

SEQ ID NO: 303453 - DNA, 3370 bp, Homo sapiens
ccaaagaattgaagtattcttaatcatgggacgatgcgtgggctcctggaatagctgactaatctttgaatgctgagattttttttccccctcattcctagtttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttccca

SEQ ID NO: 303454 - DNA, 3814 bp, Homo sapiens
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccaaagaaaaacagataaaagaaaaacacaaaagaaaaaaaaaggggggcgccacata

SEQ ID NO: 303455 - DNA, 4129 bp, Homo sapiens
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccaccattaagggtcagttgtggttattattaacgtttctggtttagttccccaagcttgacattctttaatagaaaattgtatatgatttgacaactttagtaatttttaatagtccctaagatggtttattgagttttctttcatgtttctttgtgctgtcttccttcttgcatctgtgatctgtctgccagcatgcaactcacacacatttaggaatataaaaatatgtacactgtctttccatatttcatcacaccatcacagaataatatggttatcaaaataccctcctttctagagtaagaagttgccctttgggtgaaatgtgttagctggactagggaacaattagtaacaggtattttgaaag

SEQ ID NO: 303456 - DNA, 3761 bp, Homo sapiens
  misc_feature (3150)..(3150): n is a, c, g, or t
  misc_feature (3178)..(3179): n is a, c, g, or t
  misc_feature (3193)..(3193): n is a, c, g, or t
  misc_feature (3202)..(3202): n is a, c, g, or t
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgtttttttcccccccgcccttccgccgtcgttcgtctctccccctcccctgtntccggctccccccgttgcctccctcgcnntgtcctccgggctnccccccccncccttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttccca

SEQ ID NO: 303457 - DNA, 4157 bp, Homo sapiens
  misc_feature (3797)..(3797): n is a, c, g, or t
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccaacaactacaacccggttgtaattgttctattgtgtagnttttctaggtggagcaacaggtttagggactaaacccttattaacacttggaccagttccactcttaactggctgtgacggaagatttcctactactggggatcccgatagctgtaagtcttttgtattacccttcttaatgaccagcatccctggagctctagatttaggattcggaggatattctgcataaattaagcatgacccagagtcactcaccatttcaagttttagtatagaattaaccccccaagtaccgtatattcccaaattttttttttttttaactaacagctgcctcctgggtaaaataactaaactaacaaagtactactatattccaactagtatagctacata

SEQ ID NO: 303458 - DNA, 3705 bp, Homo sapiens
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttgtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttccca

SEQ ID NO: 303459 - DNA, 2262 bp, Homo sapiens
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagcatcactgctgatcataacgagactgacatgttgagtctttcatagtgatgtatatgcaggctgtgaca

SEQ ID NO: 303460 - DNA, 1722 bp, Homo sapiens
agcggagcgggtcctgccgcgccggcagccacaggctggcatagcggctgccgacccgccctcgttcctccaccccctgcacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctggtaaaagcattgagtaggctactatgtcttactattaatctttgaattactcatgcctagtacaaaacctggcatatagttagtctagaacatttactgaatgctgtggaaaaataccaagatttgttttgaaattccttaatttctaaccattgcaattcagtagaatagctgctgtattaaataattcaaaaatatttagactaattttttggacttagagcccttgtgaacatcatatacagaatttagacacagagataccgttagcctaggaagaccaacttttcagcatttttcagagcttcagagatgaatgttcattatgtactttattttgttcacttagagtgcatttttagaaagaattaaactttttaaaaatactgtct

SEQ ID NO: 303461 - DNA, 461 bp, Homo sapiens
gcatagtgtagtcatgagccttatgcatgatcagtatgtattcatatagagtgaagttgattcgatagctagctgcatgtagctgtcagtgtttcactaggcaagataataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttccca

SEQ ID NO: 303462 - DNA, 515 bp, Homo sapiens
gtgttgatgaatatgtaagacaaaaatatacttaatttgtctattgtttaaaaatccaagatactcatttggctgcttttaaaataactgtttttatattttgtcttagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaaggtagaactctttgcttaattattgagcatattttttaccccgttatgatagtgcttctgaaccctgactgcacatcagaatcatgtgggaagctttcaaaatactgatgcctaggcagggcgtggtggctcacgcctgtaatcctagcactttgggaggccaaggcgggtggatcacctgaggtcaggagttggagaccaacttggccaacctggtgaaacccggtctctactaaaa

SEQ ID NO: 303463 - DNA, 391 bp, Homo sapiens
tttttccctttcttttctttgacaaaggaaaaactgtcagccataaaagtcttttttttttaaataacttataggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctggtaaaagcattgagtaggctactatgtcttactattaatctttgaattactcatgcctagtacaaaacctggcatatagttagtctagaacatttactgaatgctgtggaaaaataccaagatttgttttgaaattccttaatttctaaccattgcaattcag

SEQ ID NO: 303464 - DNA, 1067 bp, Homo sapiens
acacatgtgcacacacatacactcacacgtgtgtgcaggtgcacacctcccccagaggctgcagccaagacgggcatcccacatcagagggatgaatggcaggtctgtcccgccagctgtgtgctctctcccacccgaagaaagcagcagagactcagacggcggagcctggaggagcccacgcagtctgttcccggcacccggtgcgtgtgaagggacttgagggcagcgagatggaatcagcaagagaaaacatcgaccttcaacctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcccttgctccctacccacagcacctgagttaaaaagtgatttttatgttattggtctaagggacttccatcttggtctgaagtcctgagctcagacgcaggtactgccagccataccttcctggtagcatctgctggacctaagtaaggcatgtctgtctaaggccaagtctgcccggcttaaggatgctggttctgactctaccccactgcttccttctgctccaggcctcaattttcccttcttgtaaaatggaatctatatctataaaggtttcttcaaatccaa

SEQ ID NO: 303465 - DNA, 2362 bp, Homo sapiens
acacatgtgcacacacatacactcacacgtgtgtgcaggtgcacacctcccccagaggctgcagccaagacgggcatcccacatcagagggatgaatggcaggtctgtcccgccagctgtgtgctctctcccacccgaagaaagcagcagagactcagacggcggagcctggaggagcccacgcagtctgttcccggcacccggtgcgtgtgaagggacttgagggcagcgagatggaatcagcaagagaaaacatcgaccttcaacctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcccttgctccctacccacagcacctgagttaaaaagtgatttttatgttattggtctaagggacttccatcttggtctgaagtcctgagctcagacgcaggtactgccagccataccttcctggtagcatctgctggacctaagtaaggcatgtctgtctaaggccaagtctgcccggcttaaggatgctggttctgactctaccccactgcttccttctgctccaggcctcaattttcccttcttgtaaaatggaatctatatctataaaggtttcttcaaatccaaaaaaaaaaaaaaaaaaaagttgggggacaggggtctgggtttggctccaggtgggaacaaggcctggtaaagttgtttgtgtctggcccacagtgactctctgtgcacgactcaactgccaagggcatcactggccaattcttggatttagggattggctaggagttgctggggtccactcctgggcctgccccagctccttgcccagggagagggaaagagttaacggtgtgggccactccagcttgcccttccactgccactcactggggtgaggctgggggtcagcttggtgaggattggggcttctagattgtctaggcaggaggtgaaacttaggccagagtcagatttgagctgagccaggggaggccttggcaacctacttctactcagatttcattgctggatgcggaaggggtaggcccaaaatatatacaggatcttactgtcccttgaagcccagccacaagtgttggagctgcagagagaccccaaaggtagtagattgtgccagatacaaatgggtcccatccagtgcttcatactccttcagtcactatcccagacagtgagccccagatctcctagctctggcttctgtgtcccacacggcctgttcccagcttctctcctggttcccttgttacggattcatttatccattcagtgtttcctgggcctctgctcagaggcaggtcaccactgggccctgtggatcaatgcaagatgacaaaggctttttttttttttttttttttttttttttttgaggagtttcgctcttgttggctaggctggagtaaaatggtgcgatctcggctcactgcacctccgcctcccaggttcaagcgattttcctgcctcagcctcccgagtagctggggttacaggcatgcaccaccatgcctggctaattttctgtatttttagtagagacggggtttctccatgttggtcaggctggtcttgaactcctgacctcaggtgatctgcccgtctcggcctcccaaagtgctgggattaccggcatgagccactgcgcctggccgacaaaggctttgatatcagaatgaactgtcaagggaggtgctggagagggattaacctgtgctgcctgggaccctcagggtcttaggttggggagtgtgaataggagtttgcagatggagaataggaagggcattccaggcagagggaaacctgtgcagagaccaagaggtgtggaaggaaaagtggggttggggctgggtggtctggattatggcctggatgcaataaagtactgtgacagt

SEQ ID NO: 303466 - DNA, 710 bp, Homo sapiens
ggtgaggcgtggctcaaacgaccgccgctaagaacaaaacgttggctttggcttcgttgcaggaagcagccgctcggtggccgtacaacgcttcatctctccgagcctcggtttcctcatctccagccctaaaatgacgacacgccccacaggtcttgggaggattaagtgaggggacatgaggtacagttccagggacaaagccgtgttcccgaatcgggtctttcttccctgtctcccctccctagtttgtgagccgcgtcgcggcggagcggatgtaggcccgagggctggcgcgactgcagctgcgaccctttcctccgcggactcaggaacgccaccctcccctccccacccggcgcggggctgcgaggctgcgaggccgcgacggtgcagagtctccagacagccgcgccgccggagggcaggacaggagggtcgctgagggtcacaggaggggcgctgtgggccagaagaacgggcctggggtgctcctggagccctcggtggcccctgctggaggcttgggcagctgcagggggacagagcggcgcaggcagcaggggagccgggtcccgaggggaaggcgcctgtcctcgggaggtgaaggttcctgcgctccgcaggcggccgtagcccgcgggccgactcgggggaatggcaggaatgcgcgggcgccgggcggaagagccgcgcgaccggccagctgg

SEQ ID NO: 303467 - DNA, 665 bp, Homo sapiens
ggtgaggcgtggctcaaacgaccgccgctaagaacaaaacgttggctttggcttcgttgcaggaagcagccgctcggtggccgtacaacgcttcatctctccgagcctcggtttcctcatctccagccctaaaatgacgacacgccccacaggtcttgggaggattaagtgaggggacatgagcctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattggtgaggagcccagcctgcagtcagaccttctgcctcggcacccgtggctggcagaaaggccccacgtgtcccctgggccaccctgcattggcacaggcagctttgcaaccacacgctgacctgcagtgagccctccgctaacagaggcccaaagaccaacttccaccccgcgagggcaggcgccctgtcctgtctcctggtatcccatggagcagaccctccgcagtacctgctgaatgactgcgccagcacc

SEQ ID NO: 303468 - DNA, 467 bp, Homo sapiens
ggtgaggcgtggctcaaacgaccgccgctaagaacaaaacgttggctttggcttcgttgcaggaagcagccgctcggtggccgtacaacgcttcatctctccgagcctcggtttcctcatctccagccctaaaatgacgacacgccccacaggtcttgggaggattaagtgaggggacatgaggtggtcatcggtgtcctgctcgtggtcattggtgaggagcccagcctgcagtcagaccttctgcctcggcacccgtggctggcagaaaggccccacgtgtcccctgggccaccctgcattggcacaggcagctttgcaaccacacgctgacctgcagtgagccctccgctaacagaggcccaaagaccaacttccaccccgcgagggcaggcgccctgtcctgtctcctggtatcccatggagcagaccctccgcagtacctgctgaatgactgcgccagcacc

SEQ ID NO: 303469 - DNA, 984 bp, Homo sapiens
ggtgaggcgtggctcaaacgaccgccgctaagaacaaaacgttggctttggcttcgttgcaggaagcagccgctcggtggccgtacaacgcttcatctctccgagcctcggtttcctcatctccagccctaaaatgacgacacgccccacaggtcttgggaggattaagtgaggggacatgagcctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcccttgctccctacccacagcacctgagttaaaaagtgatttttatgttattggtctaagggacttccatcttggtctgaagtcctgagctcagacgcaggtactgccagccataccttcctggtagcatctgctggacctaagtaaggcatgtctgtctaaggccaagtctgcccggcttaaggatgctggttctgactctaccccactgcttccttctgctccaggcctcaattttcccttcttgtaaaatggaatctatatctataaaggtttcttcaaatccaa

SEQ ID NO: 303470 - DNA, 881 bp, Homo sapiens
ctcactagagtttgagtctgtcggtgattctcctatatagacatggcatagctgatacaaattcaagacaggaaaaggcacctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcccttgctccctacccacagcacctgagttaaaaagtgatttttatgttattggtctaagggacttccatcttggtctgaagtcctgagctcagacgcaggtactgccagccataccttcctggtagcatctgctggacctaagtaaggcatgtctgtctaaggccaagtctgcccggcttaaggatgctggttctgactctaccccactgcttccttctgctccaggcctcaattttcccttcttgtaaaatggaatctatatctataaaggtttcttcaaatccaa

SEQ ID NO: 303471 - DNA, 844 bp, Homo sapiens
cagttccaagtcagcaaatgggatctgagtcatgatgtatatgcctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcccttgctccctacccacagcacctgagttaaaaagtgatttttatgttattggtctaagggacttccatcttggtctgaagtcctgagctcagacgcaggtactgccagccataccttcctggtagcatctgctggacctaagtaaggcatgtctgtctaaggccaagtctgcccggcttaaggatgctggttctgactctaccccactgcttccttctgctccaggcctcaattttcccttcttgtaaaatggaatctatatctataaaggtttcttcaaatccaa

SEQ ID NO: 303472 - DNA, 6562 bp, Homo sapiens
gccatggaggcagatgcctttctgaaggctctgcagctggggccttttagtattttgtagactgagatgtttcatgtgtttttcttacttattttattcatagcatgcacttaatgaagttgatcctggtgactggcagaaattcgtgaagaagggactcaaatttcggtaccaggaccacacatttttaaagatgctcctcaccgccgtacagctcctgtacagcccagaaagctccgtgcgcacgaagctcatccagctcccggtggtctacgtgatgctcatgcagcactcgctgtttctgccgactctactgacgtctgacggagaggagagcccggacagccaagtaaaagaagcgctggtggacctgatgctgacggtggtggagatgtgcccctctgtctgtgagagcagccactttgcagtgcttctcggggcctatggcgccactctcagcgtcctagatcagaagattttacttctgcttcgagcgtatgagcagaacaagctcagcctcatcaacttcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccagagtttgtggtggattgtcgaaaatttttggattcaaatgctctgggcctaactgtcacagccctcagcagctatgacccccagatgcgagccatagcctaccatgtcctggcggcctactactcgcacttggagggcgcacggttccaagagcagtcccagctactttacctgttggatgtagtccggaatgggattcgaactcaggacatgagacttacttttaccttggctctcttcattgccaaagcagccctgcagattttgaaaccagaggagcacatgtacctgaaggtcagcaacttcctgctgtcgcatgagtacttgaacatggacaaagtgccaggcttctaccagttcttctacagctccgactttgagcaaaaaacagagcagaagtgggtgtttggccttctgcggcaggggatccgtgacaagcagtgctacgaactgtgtgcccggcgtggcatcttccacatcatcctgtccttcttccacagcccgctgtgtgacgaggcagcacagaattggattctggaaattctacagaatgctgcccaggttgccagatctgcgtatgaaatcatacgagactatagccttttaacatggattttacacatccttgaaagcaagtttctggagactccgctgctgtctaatgtgatctccttgctacacacactgtgggtgaccaacctgggggacaaggcagtggagtgggagagccagcgcctttgccagcctagctcccaggagcctgccaagcggcttgccctgcacctggtcaatgagttcctttatgttctcatcgtgctcatgaagcacctgaggcccaccttggcccccgtccagctgaccaacttcttcgggacacttgactccgtgctgaggtaccgggccactgtcatacaggcctttagggacatgaacagattcaccgtaaatgagacagtgctttccaccaaggacgtccttgtcctcttgcacaagtggagcctcattgaaagagacctcaagctccaggaagacctgagagcagccattgagaaggcccaagcccgggagctcatgaaaatgctcaaggataagaacaagcctgtcatgccagcccgagccaaaggcccacggggccgaaagaggaggcctggggaggcagaggagatggctgaccctgagctgatggcatctaccttggagacatgcaagggcctcctgaggtccatcttgacttactggagaccagtgatccctggtcctgaccccactcaggagcctgtggactcagccagccccgagagcgatgcgccaggccccgtatatgctgccgcttccctggcagtcagttgggtgctgcggtcggtggccgagcacccgctcagcagggcagaggctgcaggactcattggctggcttaagagccatattttgccacaccctgtggtcgtggctgacctccttaaggacagtgccgtgaggagcagcatattcaggctgtatagccggctctgtggggctgaggggctggcagggcctgtgcaggaggtggcctgcctgttcaatacggtcatgctgcagctggtggctgcccagggccgggcagggagccccttccacccggccatggaagccctctccctgtcttctctgagtgagaaggatgaagccacacaagcctccgcagcattcctagtgtctctctacataaaggacatctggctgggggctcagcggccggacaccctcttaacccacgtccggatggtgtgtgaggccgcagatgatgccccgagcagtgaagaggaggccatcgtggtgctctgcaaggacgccgccagcgcagcctcagatgcttgactcctgccggccagcaccttgcaccctgatgaccagagcctcgagcacagcaccagcttctagaagtttggttgagtcaagggtttccagagaaggcatgggaaacaacaggttcagtacattggctcagttctttgacaagaaaagttgagaggactttattgaactgcccagtaaatgataaactcgggcctgtaggtgcccagcatcagagttgcaaggaatgtggggacttctaggccatgaggcccatccagtgcctcgtcaggccgccccttcctctctaggggcttggagctcatcacaggaaatagctcgagtttgaggcagcacttctgaatgcagaagagattcatctgtgttaaagctgaaatgtcaaaaggtatcagattttttttatgaaaacgaagagagatgtttaaagtttatttttcagcaggtgaggtggctcacgcctataatcccagcactttgggaggccaaggcgggtgaatcacctgaggtcaggagttcgaaaccagccttcccaacatggtgaaaccccatctctactaaaaatacaaaaattagccaggcatggtagcgcacacctgtaattccagctactcgggaggctaaggcaggggaatcgcttgaacctgggaggtggaggctacagtgagctgagatcgtgccattgcgctccagcctaggtgacagagcaagactccatctcaaaaaaataaaaaaataaagtttgtttttctataaaaagtcataacaaagtattagtatgactttttgaataagttaatttctgccagtgtttaattattttattaaagaaaaggatgttacactgaatccttaaagaataaaagtgatttgacctctgctttgagaagacagcctgtaatttttaaagctatacttcaaagaggggattttgaattttataaatgcttgttaatgtctatttttgtaaggtttttgtgttttcctttcattgttgttaagaggctatttttgctccacataggcctgcatttattttaaaggtcagaattttactcttaatggtcatatattagttggggttgtagctgacaaaagtcatgaaatttcgtggttttcacagttaaaatttccgtctgttcctttaaaactctcctgcatgcctggggctcttgggatctgctctgtggcctaggatgtggctgttttatctgccgtataatgtacatcgtgctgacaatgccttggttttgtctgaaacatttacacttctattttccaccagtgttctttagaattgtttctgttttaggtgacttaaagttttaactaaagcatgagtaacgtttgttggcatacagtcccttcaccacaaataattgtcttgcactgtctacaaagcaaggatcagttacctcacttgtccccttccctacccaaataaaccttacaacgctattctttgagactatcctgaacttgaaatcccacgtttagatccaagctggactcaggcaagcgctgctccaacaaagcgttctcttcctggttccccttaatctttatccacctctccaaggcctatctttggggattcctttggttataggcacctctgcttgtttatgcagggggcattggccggaaggacattggtctggggaatatccctgaaccccatgcctctgggggcacagggaggggcagcgagcaggtggggtggatttccacggcttcatccctggctccaggcctaagctgcctcccaggttcttagggcccagcaagtcaatacatactacgtcaggtggcgacaaatgctccaaagccgagttccagctcagtcaagtgaggacacattttcagcacctcaccttcttttctgcatctctggagctcatcagtcttgcttttctttgttctcccttttaaatccactgccctgaccttgttcatgtattttccagtcacttagtgtggaggaagggaatctcatcccatggagaatagatcgaacatggtcttcacctgacttaaaatataaaatgctaaattagaaatatcttaagtggggcggggggcacagttattttaaaaataaaacctatcaactccctccttgcctgaaagctgtaggggacatatgggtcttctgagatttgctgtgtgatgctgtctcctctccagggacaaggctgctgggcactagaggactagatctttcaagggtcccagatccactgtcacataaagtcacatccagaagacctttcctgccagcttccagggctctttgtgttctgtgacagcatttgggcatagatcctgcttacccggcctggctgctgacaggcgttggctgcctgccctccaggggagacactttcttgggctctgtctttgaaaggctgtggggaggttgaaggtgcaactcaggtccccagactgcagtgagctgacctggcagggcagatgccatcacatctgggggagccggcgggtgttagtggagcttggatgggaacttacccagcatcctaacaaaggtacagaaggaccaggtgaactcagggctgataacgcattacacagtaatggtaaagtggcatagtaaagattagtaagcaaacagcttttcctcttgatttgcatatattttattttcctactcttccctgagcaaatataagcagtaagcaagcaggctaggtgtgctcaataaactcagcaacacctgggatgacctctgcactcgaggggccactgcaatctttgtcaaaggcataggatgctcctgctctagttgcacttgacctaggtgccctttctgctacatgcaaatggcctctaagaagaacgaggaacgtatgtgtccaggttggcttgatttcaccagttcactcagctatggccacgatttactgacatcagctctgcaattgagaggtcctgtctccagggggaggctcgctgggcttgctcctgacgaggggacccccattgagggtcagttcccagaggagagtggggtgggtctggaaacccccgaggggcaaggtggaggagctctcctgtcgtagcggctggtcagggccagttctgctccctggctccactgagctcgcctgagcctgtgaggttgccaggggttccctgtggcacggcaggcacttctggatgcagaggtggaggttgaggccgtgactccaggggcatgtttggtggtgcttggggctgttcctgtgaacagagcagagtgggaggcaggcatcatagttgctgcagaacagtccatactgtggggctggggggtttcctgccacacctgccatctgcccggaccccatagggaaggccacacaggcaaattcctgagaagggtcagccagctcacaaaggtggccattctagagaaatctcagaggagaggaagtgctttgtcaggaactaggcctcaggtctttccctggaggccacttcttcctacattgatttaggatggggggggtggggggtggaggggagcaggttgacctcccatccagcgctgtatctgagtgtagttcattttatatccatagcccaagccaacttgtatcttggtgatatggtttggctgcgtcacgacacaaatctcaccttgaattgtaataatccccacgtgtcgtgggaaggacccagtgggaggtaattgaatcatgggggcgggtcttcccatgctgttctcgtgatagtaagtctcatgagatctgatggttttataaaggggagtttccctgcacatgcccttttgcctgtgtcatgtaagatgtggctttgctcttcctttgccttctgccatgactgtgaagcctcccccgccatgtgaaactgtgagtccattaaacctctttcctttataaatta

SEQ ID NO: 303473 - DNA, 10647 bp, Homo sapiens
cgcgcccgcaaagaagagctcacgggcgtgcggttcaaggctcagctgaaggacccgcagggccccgggccaggcttggaagcgtttgtgtctgctgccaagaagctaccacgagaagatgtgtatgatgttgtggaagggtatataaagatttctgttgagtgtgtcgaaattttccagctcctaagtggagagaaacgacctgaaagtgaaacgatgttaatatttcaagttttcgaggccatattattgcggacagcaagtgatctttcacatttccatgttgtgggaaccaacattgtgaaaaagctgatgaacaaccacatgaagctcatctgtgagtccctgtatgcctcaggttacaggttggctcgcgcctgcctgagcctgatgaccgccatggtgacccagggtccggaagctgccagggacgtctgcagccattttgatttgaataaaaagaccctgtacaccctggtgaccaagagggattcaaagggagtgtacgacgttcggcaggcctacgttcagtttgctctctcctttttaattgcgggtgatgacagcactatagtgcaggtgttggaagtgaaagaatttattccttgcatttttagctcagggataaaggaagataggatctctaccatcaatattttattatccacactgaaaacaaaggtagttcacaataaaaatatcacaaaaacccagaaggtgcgtttctttacggggcagttattgaaccacatagcatcgctgtacaactggaatgggattaccgatgtgaacccagaaaatgtcaaggtttctgccgaagaagcagggaaaaccatggtgcgggagcttgttcataacttcctgatggatctttgctgttcactcaagcatggaattaatttttacgatgcatctttgggtacctttggcagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaagatctatgaggctcagccggagatttcccgggcatttcagaccagagagtttatacccttgcctcggctcctggcaatggtgatggtgaccaccgtgcccctggtgtgcaataagagcatgttcacccaagcattaaacttggacagcacctcagtgaggcacacagccttatcccttatttctgtcattttgaagagggcattaaaaactgttgaccactgcctgaataaagaggtgtggcaggaatcaggcgtgtacacagctgtgatgatggaagaattcgtgcagctcttcagagaagccctgagcaagattttgccagacctgaacactgtcgtgtgggtctggcagtcacttaaaaagcaagagaccaaacaggatgacaagaaagggcagaaaaggagcgatgggcccccggctgcctgcgatgctcaccagtgcgatgatgcagaaaccattcttttgaaagctgttttgctccaggtcatatgcctctaccagaaggtggtcccccacgtggtcatgcagtacaactttgacttcagcaagctcctgaaaggtgtcatctctgagcagggccttcgagaggaggtgcctcccattctgcagcaccacatgctgaaggtggccctggagctgccggccagcaagtttctgtggttaaaggcacaggaaggcccagatgcagaaattattggaggtgaacgatcagtattttacttactaatgaaaatgtttgtgaccagtagccatttacaactgaagtcattgaccaaacttctgatcatgaagattctgcgggacacgggggtgtttgagcacacctggaaggagctggagctctggctggagcatttagagaacaccatggaagaggacaaagagactgtgattcagtttctggaacgcattttattgacattggtggcgaatccctattcatacacagacaaagcatctgactttgtccaagaagcaagcatgctgcaggccactatgacgaagcaagaagccgatgacatgagcattcccatctcccacattgacgatgttctcgacatggtggatgtcctggtggagggcagtgaaggcttggatgaggaaatagggttcacgttgagtgaagacatgatcctgctcacgttcccattcagtgcggtagtccctgcggccctggaagccaggaataagttgctccttgggacaggcaatgaagcagcggaaaacgttgtgacatatctgacggcagtgctgactgacctcctccacacccagagggaccccctggctctgtgtctcctgctccaggcatatgataagcttgagcctccatgcctggtgccttgctgccagcagctctcacggtttaacagatactacagcctctggatcccggagcaagcccgagaggcctggctgctgcaggcacagggcagcccctcgccccctgcccttcccttggcctcgtccttcacagccctgctgcaggcagcctacgagagccaagcgcttcgggacgagcacatccaggtgcagctgcaggccaccatgccacacctgtccatgcagcaggtcctgctcgcggccaagcaggtgttgctctacctgcggagcactgtggagaacttcggccagctgggcagaagtgtgggcccgcccctcctgcagctcttcctggatctcctcaggcgcctggttgtccactgtgagcagctggatgcccagaaccagcagagatgcgaggccgcccgggccgaagccgacctcttcctggacatggagtccgtggcctcgctggagttggccaatgatcagacgctggaggaggtgcttgtggccatcctcaggcaccccaccctggagggctggttcctggccctggagcagcaggccctcccgccgcacacgctcagccctgtcctcgtgaagctcctggccacccactttagtgcaggggtccttcagctgctggcagcaagtgccccgatcctccagaacattgggcagctgggccttctggccaggtactcagaggccatcacccagagtgtgctgaaggaacttcagaacaggagggcgggcccggccacatcaccaccaaagaccccgccgcagctggaggccctgcaggagctgcatccatacatggagggtgcccagctccgtgaggtcaccctggccttgctgagcctgcctgagacacacctggtgacccagcaacccacgaaatcccccgggaaggaaagacacctgaatgctcttggaaagaccctggtgcagctgctgacctgcagcccccaggatcagctgcagagtggtgagctcctgtggtcctccgagtatgtgagaggcctgggggctctgctgcccacgctagcagtggacgagctggacacagtgctcctccacactctgcagagagaccctgtgctggcccccgcagtcggggctgatctgcttgactactgcctggcccggcgcacacaggcggccctcagcatcgctgccctgctcctccaggagagctgcacccacttgctgtggttcgagcagtggtgcctgcaggctggcccagggctcggcctccagggggacctggacgacttccttcccctcatccatgtgtacctccagtgcaggacacggagccacttcacacgcccagcaggagtgtcttccgctgtcattcctgtcttgaggaagaccctgtggaggcagctacagagcaggcttcttagcactgacagtcccccagcatctgggctgtaccaggagatcctggcacagctggtcccgtttgcacgagccaaggatctcagtgtactcatggaccgcctgcccagcttgcttcacaccccaagcagtcacaagaggtggatcgtggccgactccatttcagcagctctggaagggtcagcagaagagctgtgtgcctggagaaggacccttttggagtcctgtgtgaagtggctgatcgtgtctttcagtggtggacagcaagatgatgataatactcagaatcaggagaaggaaatgctgcttagattaaatgcgttgttgcatgcacttaatgaagttgatcctggtgactggcagaaattcgtgaagaagggactcaaatttcggtaccaggaccacacatttttaaagatgctcctcaccgccgtacagctcctgtacagcccagaaagctccgtgcgcacgaagctcatccagctcccggtggtctacgtgatgctcatgcagcactcgctgtttctgccgactctactgacgtctgacggagaggagagcccggacagccaagtaaaagaagcgctggtggacctgatgctgacggtggtggagatgtgcccctctgtctgtgagagcagccactttgcagtgcttctcggggcctatggcgccactctcagcgtcctagatcagaagattttacttctgcttcgagcgtatgagcagaacaagctcagcctcatcaacttcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccagagtttgtggtggattgtcgaaaatttttggattcaaatgctctgggcctaactgtcacagccctcagcagctatgacccccagatgcgagccatagcctaccatgtcctggcggcctactactcgcacttggagggcgcacggttccaagagcagtcccagctactttacctgttggatgtagtccggaatgggattcgaactcaggacatgagacttacttttaccttggctctcttcattgccaaagcagccctgcagattttgaaaccagaggagcacatgtacctgaaggtcagcaacttcctgctgtcgcatgagtacttgaacatggacaaagtgccaggcttctaccagttcttctacagctccgactttgagcaaaaaacagagcagaagtgggtgtttggccttctgcggcaggggatccgtgacaagcagtgctacgaactgtgtgcccggcgtggcatcttccacatcatcctgtccttcttccacagcccgctgtgtgacgaggcagcacagaattggattctggaaattctacagaatgctgcccaggttgccagatctgcgtatgaaatcatacgagactatagccttttaacatggattttacacatccttgaaagcaagtttctggagactccgctgctgtctaatgtgatctccttgctacacacactgtgggtgaccaacctgggggacaaggcagtggagtgggagagccagcgcctttgccagcctagctcccaggagcctgccaagcggcttgccctgcacctggtcaatgagttcctttatgttctcatcgtgctcatgaagcacctgaggcccaccttggcccccgtccagctgaccaacttcttcgggacacttgactccgtgctgaggtaccgggccactgtcatacaggcctttagggacatgaacagattcaccgtaaatgagacagtgctttccaccaaggacgtccttgtcctcttgcacaagtggagcctcattgaaagagacctcaagctccaggaagacctgagagcagccattgagaaggcccaagcccgggagctcatgaaaatgctcaaggataagaacaagcctgtcatgccagcccgagccaaaggcccacggggccgaaagaggaggcctggggaggcagaggagatggctgaccctgagctgatggcatctaccttggagacatgcaagggcctcctgaggtccatcttgacttactggagaccagtgatccctggtcctgaccccactcaggagcctgtggactcagccagccccgagagcgatgcgccaggccccgtatatgctgccgcttccctggcagtcagttgggtgctgcggtcggtggccgagcacccgctcagcagggcagaggctgcaggactcattggctggcttaagagccatattttgccacaccctgtggtcgtggctgacctccttaaggacagtgccgtgaggagcagcatattcaggctgtatagccggctctgtggggctgaggggctggcagggcctgtgcaggaggtggcctgcctgttcaatacggtcatgctgcagctggtggctgcccagggccgggcagggagccccttccacccggccatggaagccctctccctgtcttctctgagtgagaaggatgaagccacacaagcctccgcagcattcctagtgtctctctacataaaggacatctggctgggggctcagcggccggacaccctcttaacccacgtccggatggtgtgtgaggccgcagatgatgccccgagcagtgaagaggaggccatcgtggtgctctgcaaggacgccgccagcgcagcctcagatgcttgactcctgccggccagcaccttgcaccctgatgaccagagcctcgagcacagcaccagcttctagaagtttggttgagtcaagggtttccagagaaggcatgggaaacaacaggttcagtacattggctcagttctttgacaagaaaagttgagaggactttattgaactgcccagtaaatgataaactcgggcctgtaggtgcccagcatcagagttgcaaggaatgtggggacttctaggccatgaggcccatccagtgcctcgtcaggccgccccttcctctctaggggcttggagctcatcacaggaaatagctcgagtttgaggcagcacttctgaatgcagaagagattcatctgtgttaaagctgaaatgtcaaaaggtatcagattttttttatgaaaacgaagagagatgtttaaagtttatttttcagcaggtgaggtggctcacgcctataatcccagcactttgggaggccaaggcgggtgaatcacctgaggtcaggagttcgaaaccagccttcccaacatggtgaaaccccatctctactaaaaatacaaaaattagccaggcatggtagcgcacacctgtaattccagctactcgggaggctaaggcaggggaatcgcttgaacctgggaggtggaggctacagtgagctgagatcgtgccattgcgctccagcctaggtgacagagcaagactccatctcaaaaaaataaaaaaataaagtttgtttttctataaaaagtcataacaaagtattagtatgactttttgaataagttaatttctgccagtgtttaattattttattaaagaaaaggatgttacactgaatccttaaagaataaaagtgatttgacctctgctttgagaagacagcctgtaatttttaaagctatacttcaaagaggggattttgaattttataaatgcttgttaatgtctatttttgtaaggtttttgtgttttcctttcattgttgttaagaggctatttttgctccacataggcctgcatttattttaaaggtcagaattttactcttaatggtcatatattagttggggttgtagctgacaaaagtcatgaaatttcgtggttttcacagttaaaatttccgtctgttcctttaaaactctcctgcatgcctggggctcttgggatctgctctgtggcctaggatgtggctgttttatctgccgtataatgtacatcgtgctgacaatgccttggttttgtctgaaacatttacacttctattttccaccagtgttctttagaattgtttctgttttaggtgacttaaagttttaactaaagcatgagtaacgtttgttggcatacagtcccttcaccacaaataattgtcttgcactgtctacaaagcaaggatcagttacctcacttgtccccttccctacccaaataaaccttacaacgctattctttgagactatcctgaacttgaaatcccacgtttagatccaagctggactcaggcaagcgctgctccaacaaagcgttctcttcctggttccccttaatctttatccacctctccaaggcctatctttggggattcctttggttataggcacctctgcttgtttatgcagggggcattggccggaaggacattggtctggggaatatccctgaaccccatgcctctgggggcacagggaggggcagcgagcaggtggggtggatttccacggcttcatccctggctccaggcctaagctgcctcccaggttcttagggcccagcaagtcaatacatactacgtcaggtggcgacaaatgctccaaagccgagttccagctcagtcaagtgaggacacattttcagcacctcaccttcttttctgcatctctggagctcatcagtcttgcttttctttgttctcccttttaaatccactgccctgaccttgttcatgtattttccagtcacttagtgtggaggaagggaatctcatcccatggagaatagatcgaacatggtcttcacctgacttaaaatataaaatgctaaattagaaatatcttaagtggggcggggggcacagttattttaaaaataaaacctatcaactccctccttgcctgaaagctgtaggggacatatgggtcttctgagatttgctgtgtgatgctgtctcctctccagggacaaggctgctgggcactagaggactagatctttcaagggtcccagatccactgtcacataaagtcacatccagaagacctttcctgccagcttccagggctctttgtgttctgtgacagcatttgggcatagatcctgcttacccggcctggctgctgacaggcgttggctgcctgccctccaggggagacactttcttgggctctgtctttgaaaggctgtggggaggttgaaggtgcaactcaggtccccagactgcagtgagctgacctggcagggcagatgccatcacatctgggggagccggcgggtgttagtggagcttggatgggaacttacccagcatcctaacaaaggtacagaaggaccaggtgaactcagggctgataacgcattacacagtaatggtaaagtggcatagtaaagattagtaagcaaacagcttttcctcttgatttgcatatattttattttcctactcttccctgagcaaatataagcagtaagcaagcaggctaggtgtgctcaataaactcagcaacacctgggatgacctctgcactcgaggggccactgcaatctttgtcaaaggcataggatgctcctgctctagttgcacttgacctaggtgccctttctgctacatgcaaatggcctctaagaagaacgaggaacgtatgtgtccaggttggcttgatttcaccagttcactcagctatggccacgatttactgacatcagctctgcaattgagaggtcctgtctccagggggaggctcgctgggcttgctcctgacgaggggacccccattgagggtcagttcccagaggagagtggggtgggtctggaaacccccgaggggcaaggtggaggagctctcctgtcgtagcggctggtcagggccagttctgctccctggctccactgagctcgcctgagcctgtgaggttgccaggggttccctgtggcacggcaggcacttctggatgcagaggtggaggttgaggccgtgactccaggggcatgtttggtggtgcttggggctgttcctgtgaacagagcagagtgggaggcaggcatcatagttgctgcagaacagtccatactgtggggctggggggtttcctgccacacctgccatctgcccggaccccatagggaaggccacacaggcaaattcctgagaagggtcagccagctcacaaaggtggccattctagagaaatctcagaggagaggaagtgctttgtcaggaactaggcctcaggtctttccctggaggccacttcttcctacattgatttaggatggggggggtggggggtggaggggagcaggttgacctcccatccagcgctgtatctgagtgtagttcattttatatccatagcccaagccaacttgtatcttggtgatatggtttggctgcgtcacgacacaaatctcaccttgaattgtaataatccccacgtgtcgtgggaaggacccagtgggaggtaattgaatcatgggggcgggtcttcccatgctgttctcgtgatagtaagtctcatgagatctgatggttttataaaggggagtttccctgcacatgcccttttgcctgtgtcatgtaagatgtggctttgctcttcctttgccttctgccatgactgtgaagcctcccccgccatgtgaaactgtgagtccattaaacctctttcctttataaatta

SEQ ID NO: 303474 - DNA, 6795 bp, Homo sapiens
ggtcagactgtaataaactgctattaataagtcgaagacagccattagccacatcactggtatgggtagtagaaaaactaaaagggctccaccattcaattcaggcaagagtagacagagtagaggctttggtagcacagtcatggggaaaacatgcctggattgaaaatctgtattggcttaacatttgggagggggaatgcgcagggactgaattcagccttgtcaaaggcctaggaagaaaggtgactgtggagatgtcttaattgaaaaacacgtggggggctgggcgcggtggctcatgcctctgatcccagcactttgggatgccaaggaggattgcttgagctaaggagttcagcctgggcaacatagcacgacctcatctcaaaaaaaaagaaaaaaagaaaataaaataataataacaaaaaaataagcggggaagggattagatggcagtccaaacaccagtattattcagaggaggagatttccagcatttcaatgttgcctggaaggctctctcctcttctggtattcagtgtgtctgccccaccatgccatgtgtttcagggttgttttcttgcagaagcgctggtggacctgatgctgacggtggtggagatgtgcccctctgtctgtgagagcagccactttgcagtgcttctcggggcctatggcgccactctcagcgtcctagatcagaagattttacttctgcttcgagcgtatgagcagaacaagctcagcctcatcaacttcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccagagtttgtggtggattgtcgaaaatttttggattcaaatgctctgggcctaactgtcacagccctcagcagctatgacccccagatgcgagccatagcctaccatgtcctggcggcctactactcgcacttggagggcgcacggttccaagagcagtcccagctactttacctgttggatgtagtccggaatgggattcgaactcaggacatgagacttacttttaccttggctctcttcattgccaaagcagccctgcagattttgaaaccagaggagcacatgtacctgaaggtcagcaacttcctgctgtcgcatgagtacttgaacatggacaaagtgccaggcttctaccagttcttctacagctccgactttgagcaaaaaacagagcagaagtgggtgtttggccttctgcggcaggggatccgtgacaagcagtgctacgaactgtgtgcccggcgtggcatcttccacatcatcctgtccttcttccacagcccgctgtgtgacgaggcagcacagaattggattctggaaattctacagaatgctgcccaggttgccagatctgcgtatgaaatcatacgagactatagccttttaacatggattttacacatccttgaaagcaagtttctggagactccgctgctgtctaatgtgatctccttgctacacacactgtgggtgaccaacctgggggacaaggcagtggagtgggagagccagcgcctttgccagcctagctcccaggagcctgccaagcggcttgccctgcacctggtcaatgagttcctttatgttctcatcgtgctcatgaagcacctgaggcccaccttggcccccgtccagctgaccaacttcttcgggacacttgactccgtgctgaggtaccgggccactgtcatacaggcctttagggacatgaacagattcaccgtaaatgagacagtgctttccaccaaggacgtccttgtcctcttgcacaagtggagcctcattgaaagagacctcaagctccaggaagacctgagagcagccattgagaaggcccaagcccgggagctcatgaaaatgctcaaggataagaacaagcctgtcatgccagcccgagccaaaggcccacggggccgaaagaggaggcctggggaggcagaggagatggctgaccctgagctgatggcatctaccttggagacatgcaagggcctcctgaggtccatcttgacttactggagaccagtgatccctggtcctgaccccactcaggagcctgtggactcagccagccccgagagcgatgcgccaggccccgtatatgctgccgcttccctggcagtcagttgggtgctgcggtcggtggccgagcacccgctcagcagggcagaggctgcaggactcattggctggcttaagagccatattttgccacaccctgtggtcgtggctgacctccttaaggacagtgccgtgaggagcagcatattcaggctgtatagccggctctgtggggctgaggggctggcagggcctgtgcaggaggtggcctgcctgttcaatacggtcatgctgcagctggtggctgcccagggccgggcagggagccccttccacccggccatggaagccctctccctgtcttctctgagtgagaaggatgaagccacacaagcctccgcagcattcctagtgtctctctacataaaggacatctggctgggggctcagcggccggacaccctcttaacccacgtccggatggtgtgtgaggccgcagatgatgccccgagcagtgaagaggaggccatcgtggtgctctgcaaggacgccgccagcgcagcctcagatgcttgactcctgccggccagcaccttgcaccctgatgaccagagcctcgagcacagcaccagcttctagaagtttggttgagtcaagggtttccagagaaggcatgggaaacaacaggttcagtacattggctcagttctttgacaagaaaagttgagaggactttattgaactgcccagtaaatgataaactcgggcctgtaggtgcccagcatcagagttgcaaggaatgtggggacttctaggccatgaggcccatccagtgcctcgtcaggccgccccttcctctctaggggcttggagctcatcacaggaaatagctcgagtttgaggcagcacttctgaatgcagaagagattcatctgtgttaaagctgaaatgtcaaaaggtatcagattttttttatgaaaacgaagagagatgtttaaagtttatttttcagcaggtgaggtggctcacgcctataatcccagcactttgggaggccaaggcgggtgaatcacctgaggtcaggagttcgaaaccagccttcccaacatggtgaaaccccatctctactaaaaatacaaaaattagccaggcatggtagcgcacacctgtaattccagctactcgggaggctaaggcaggggaatcgcttgaacctgggaggtggaggctacagtgagctgagatcgtgccattgcgctccagcctaggtgacagagcaagactccatctcaaaaaaataaaaaaataaagtttgtttttctataaaaagtcataacaaagtattagtatgactttttgaataagttaatttctgccagtgtttaattattttattaaagaaaaggatgttacactgaatccttaaagaataaaagtgatttgacctctgctttgagaagacagcctgtaatttttaaagctatacttcaaagaggggattttgaattttataaatgcttgttaatgtctatttttgtaaggtttttgtgttttcctttcattgttgttaagaggctatttttgctccacataggcctgcatttattttaaaggtcagaattttactcttaatggtcatatattagttggggttgtagctgacaaaagtcatgaaatttcgtggttttcacagttaaaatttccgtctgttcctttaaaactctcctgcatgcctggggctcttgggatctgctctgtggcctaggatgtggctgttttatctgccgtataatgtacatcgtgctgacaatgccttggttttgtctgaaacatttacacttctattttccaccagtgttctttagaattgtttctgttttaggtgacttaaagttttaactaaagcatgagtaacgtttgttggcatacagtcccttcaccacaaataattgtcttgcactgtctacaaagcaaggatcagttacctcacttgtccccttccctacccaaataaaccttacaacgctattctttgagactatcctgaacttgaaatcccacgtttagatccaagctggactcaggcaagcgctgctccaacaaagcgttctcttcctggttccccttaatctttatccacctctccaaggcctatctttggggattcctttggttataggcacctctgcttgtttatgcagggggcattggccggaaggacattggtctggggaatatccctgaaccccatgcctctgggggcacagggaggggcagcgagcaggtggggtggatttccacggcttcatccctggctccaggcctaagctgcctcccaggttcttagggcccagcaagtcaatacatactacgtcaggtggcgacaaatgctccaaagccgagttccagctcagtcaagtgaggacacattttcagcacctcaccttcttttctgcatctctggagctcatcagtcttgcttttctttgttctcccttttaaatccactgccctgaccttgttcatgtattttccagtcacttagtgtggaggaagggaatctcatcccatggagaatagatcgaacatggtcttcacctgacttaaaatataaaatgctaaattagaaatatcttaagtggggcggggggcacagttattttaaaaataaaacctatcaactccctccttgcctgaaagctgtaggggacatatgggtcttctgagatttgctgtgtgatgctgtctcctctccagggacaaggctgctgggcactagaggactagatctttcaagggtcccagatccactgtcacataaagtcacatccagaagacctttcctgccagcttccagggctctttgtgttctgtgacagcatttgggcatagatcctgcttacccggcctggctgctgacaggcgttggctgcctgccctccaggggagacactttcttgggctctgtctttgaaaggctgtggggaggttgaaggtgcaactcaggtccccagactgcagtgagctgacctggcagggcagatgccatcacatctgggggagccggcgggtgttagtggagcttggatgggaacttacccagcatcctaacaaaggtacagaaggaccaggtgaactcagggctgataacgcattacacagtaatggtaaagtggcatagtaaagattagtaagcaaacagcttttcctcttgatttgcatatattttattttcctactcttccctgagcaaatataagcagtaagcaagcaggctaggtgtgctcaataaactcagcaacacctgggatgacctctgcactcgaggggccactgcaatctttgtcaaaggcataggatgctcctgctctagttgcacttgacctaggtgccctttctgctacatgcaaatggcctctaagaagaacgaggaacgtatgtgtccaggttggcttgatttcaccagttcactcagctatggccacgatttactgacatcagctctgcaattgagaggtcctgtctccagggggaggctcgctgggcttgctcctgacgaggggacccccattgagggtcagttcccagaggagagtggggtgggtctggaaacccccgaggggcaaggtggaggagctctcctgtcgtagcggctggtcagggccagttctgctccctggctccactgagctcgcctgagcctgtgaggttgccaggggttccctgtggcacggcaggcacttctggatgcagaggtggaggttgaggccgtgactccaggggcatgtttggtggtgcttggggctgttcctgtgaacagagcagagtgggaggcaggcatcatagttgctgcagaacagtccatactgtggggctggggggtttcctgccacacctgccatctgcccggaccccatagggaaggccacacaggcaaattcctgagaagggtcagccagctcacaaaggtggccattctagagaaatctcagaggagaggaagtgctttgtcaggaactaggcctcaggtctttccctggaggccacttcttcctacattgatttaggatggggggggtggggggtggaggggagcaggttgacctcccatccagcgctgtatctgagtgtagttcattttatatccatagcccaagccaacttgtatcttggtgatatggtttggctgcgtcacgacacaaatctcaccttgaattgtaataatccccacgtgtcgtgggaaggacccagtgggaggtaattgaatcatgggggcgggtcttcccatgctgttctcgtgatagtaagtctcatgagatctgatggttttataaaggggagtttccctgcacatgcccttttgcctgtgtcatgtaagatgtggctttgctcttcctttgccttctgccatgactgtgaagcctcccccgccatgtgaaactgtgagtccattaaacctctttcctttataaatta

SEQ ID NO: 303475 - DNA, 10593 bp, Homo sapiens
cgcgcccgcaaagaagagctcacgggcgtgcggttcaaggctcagctgaaggacccgcagggccccgggccaggcttggaagcgtttgtgtctgctgccaagaagctaccacgagaagatgtgtatgatgttgtggaagggtatataaagatttctgttgagtgtgtcgaaattttccagctcctaagtggagagaaacgacctgaaagtgaaacgatgttaatatttcaagttttcgaggccatattattgcggacagcaagtgatctttcacatttccatgttgtgggaaccaacattgtgaaaaagctgatgaacaaccacatgaagctcatctgtgagtccctgtatgcctcaggttacaggttggctcgcgcctgcctgagcctgatgaccgccatggtgacccagggtccggaagctgccagggacgtctgcagccattttgatttgaataaaaagaccctgtacaccctggtgaccaagagggattcaaagggagtgtacgacgttcggcaggcctacgttcagtttgctctctcctttttaattgcgggtgatgacagcactatagtgcaggtgttggaagtgaaagaatttattccttgcatttttagctcagggataaaggaagataggatctctaccatcaatattttattatccacactgaaaacaaaggtagttcacaataaaaatatcacaaaaacccagaaggtgcgtttctttacggggcagttattgaaccacatagcatcgctgtacaactggaatgggattaccgatgtgaacccagaaaatgtcaaggtttctgccgaagaagcagggaaaaccatggtgcgggagcttgttcataacttcctgatggatctttgctgttcactcaagcatggaattaatttttacgatgcatctttgggtacctttggcagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaagatctatgaggctcagccggagatttcccgggcatttcagaccagagagtttatacccttgcctcggctcctggcaatggtgatggtgaccaccgtgcccctggtgtgcaataagagcatgttcacccaagcattaaacttggacagcacctcagtgaggcacacagccttatcccttatttctgtcattttgaagagggcattaaaaactgttgaccactgcctgaataaagaggtgtggcaggaatcaggcgtgtacacagctgtgatgatggaagaattcgtgcagctcttcagagaagccctgagcaagattttgccagacctgaacactgtcgtgtgggtctggcagtcacttaaaaagcaagagaccaaacaggatgacaagaaagggcagaaaaggagcgatgggcccccggctgcctgcgatgctcaccagtgcgatgatgcagaaaccattcttttgaaagctgttttgctccaggtcatatgcctctaccagaaggtggtcccccacgtggtcatgcagtacaactttgacttcagcaagctcctgaaaggtgtcatctctgagcagggccttcgagaggaggtgcctcccattctgcagcaccacatgctgaaggtggccctggagctgccggccagcaagtttctgtggttaaaggcacaggaaggcccagatgcagaaattattggaggtgaacgatcagtattttacttactaatgaaaatgtttgtgaccagtagccatttacaactgaagtcattgaccaaacttctgatcatgaagattctgcgggacacgggggtgtttgagcacacctggaaggagctggagctctggctggagcatttagagaacaccatggaagaggacaaagagactgtgattcagtttctggaacgcattttattgacattggtggcgaatccctattcatacacagacaaagcatctgactttgtccaagaagcaagcatgctgcaggccactatgacgaagcaagaagccgatgacatgagcattcccatctcccacattgacgatgttctcgacatggtggatgtcctggtggagggcagtgaaggcttggatgaggaaatagggttcacgttgagtgaagacatgatcctgctcacgttcccattcagtgcggtagtccctgcggccctggaagccaggaataagttgctccttgggacaggcaatgaagcagcggaaaacgttgtgacatatctgacggcagtgctgactgacctcctccacacccagagggaccccctggctctgtgtctcctgctccaggcatatgataagcttgagcctccatgcctggtgccttgctgccagcagctctcacggtttaacagatactacagcctctggatcccggagcaagcccgagaggcctggctgctgcaggcacagggcagcccctcgccccctgcccttcccttggcctcgtccttcacagccctgctgcaggcagcctacgagagccaagcgcttcgggacgagcacatccaggtgcagctgcaggccaccatgccacacctgtccatgcagcaggtcctgctcgcggccaagcaggtgttgctctacctgcggagcactgtggagaacttcggccagctgggcagaagtgtgggcccgcccctcctgcagctcttcctggatctcctcaggcgcctggttgtccactgtgagcagctggatgcccagaaccagcagagatgcgaggccgcccgggccgaagccgacctcttcctggacatggagtccgtggcctcgctggagttggccaatgatcagacgctggaggaggtgcttgtggccatcctcaggcaccccaccctggagggctggttcctggccctggagcagcaggccctcccgccgcacacgctcagccctgtcctcgtgaagctcctggccacccactttagtgcaggggtccttcagctgctggcagcaagtgccccgatcctccagaacattgggcagctgggccttctggccaggtactcagaggccatcacccagagtgtgctgaaggaacttcagaacaggagggcgggcccggccacatcaccaccaaagaccccgccgcagctggaggccctgcaggagctgcatccatacatggagggtgcccagctccgtgaggtcaccctggccttgctgagcctgcctgagacacacctggtgacccagcaacccacgaaatcccccgggaaggaaagacacctgaatgctcttggaaagaccctggtgcagctgctgacctgcagcccccaggatcagctgcagagtggtgagctcctgtggtcctccgagtatgtgagaggcctgggggctctgctgcccacgctagcagtggacgagctggacacagtgctcctccacactctgcagagagaccctgtgctggcccccgcagtcggggctgatctgcttgactactgcctggcccggcgcacacaggcggccctcagcatcgctgccctgctcctccaggagagctgcacccacttgctgtggttcgagcagtggtgcctgcaggctggcccagggctcggcctccagggggacctggacgacttccttcccctcatccatgtgtacctccagtgcaggacacggagccacttcacacgcccagcaggagtgtcttccgctgtcattcctgtcttgaggaagaccctgtggaggcagctacagagcaggcttcttagcactgacagtcccccagcatctgggctgtaccaggagatcctggcacagctggtcccgtttgcacgagccaaggatctcagtgtactcatggaccgcctgcccagcttgcttcacaccccaagcagtcacaagaggtggatcgtggccgactccatttcagcagctctggaagggtcagcagaagagctgtgtgcctggagaaggacccttttggagtcctgtgtgaagtggctgatcgtgtctttcagtggtggacagcaagatgatgataatactcagaatcaggagaaggaaatgctgcttagattaaatgcgttgttgcatgcacttaatgaagttgatcctggtgactggcagaaattcgtgaagaagggactcaaatttcggtaccaggaccacacatttttaaagatgctcctcaccgccgtacagctcctgtacagcccagaaagctccgtgcgcacgaagctcatccagctcccggtggtctacgtgatgctcatgcagcactcgctgtttctgccgactctactgacgtctgacggagaggagagcccggacagccaagtaaaagaagcgctggtggacctgatgctgacggtggtggagatgtgcccctctgtctgtgagagcagccactttgcagtgcttctcggggcctatggcgccactctcagcgtcctagatcagaagattttacttctgcttcgagcgtatgagcagaacaagctcagcctcatcaacttcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccagagtttgtggtggattgtcgaaaatttttggattcaaatgctctgggcctaactgtcacagccctcagcagctatgacccccagatgcgagccatagcctaccatgtcctggcggcctactactcgcacttggagggcgcacggttccaagagcagtcccagctactttacctgttggatgtagtccggaatgggattcgaactcaggacatgagacttacttttaccttggctctcttcattgccaaagcagccctgcagattttgaaaccagaggagcacatgtacctgaaggtcagcaacttcctgctgtcgcatgagtacttgaacatggacaaagtgccaggcttctaccagttcttctacagctccgactttgagcaaaaaacagagcagaagtgggtgtttggccttctgcggcaggggatccgtgacaagcagtgctacgaactgtgtgcccggcgtggcatcttccacatcatcctgtccttcttccacagcccgctgtgtgacgaggcagcacagaattggattctggaaattctacagaatgctgcccaggttgccagatctgcgtatgaaatcatacgagactatagccttttaacatggattttacacatccttgaaagcaagtttctggagactccgctgctgtctaatgtgatctccttgctacacacactgtgggtgaccaacctgggggacaaggcagtggagtgggagagccagcgcctttgccagcctagctcccaggagcctgccaagcggcttgccctgcacctggtcaatgagttcctttatgttctcatcgtgctcatgaagcacctgaggcccaccttggcccccgtccagctgaccaacttcttcgggacacttgactccgtgctgaggtaccgggccactgtcatacaggcctttagggacatgaacagattcaccgtaaatgagacagtgctttccaccaaggacgtccttgtcctcttgcacaagtggagcctcattgaaagagacctcaagctccaggaagacctgagagcagccattgagaaggcccaagcccgggagctcatgaggggccgaaagaggaggcctggggaggcagaggagatggctgaccctgagctgatggcatctaccttggagacatgcaagggcctcctgaggtccatcttgacttactggagaccagtgatccctggtcctgaccccactcaggagcctgtggactcagccagccccgagagcgatgcgccaggccccgtatatgctgccgcttccctggcagtcagttgggtgctgcggtcggtggccgagcacccgctcagcagggcagaggctgcaggactcattggctggcttaagagccatattttgccacaccctgtggtcgtggctgacctccttaaggacagtgccgtgaggagcagcatattcaggctgtatagccggctctgtggggctgaggggctggcagggcctgtgcaggaggtggcctgcctgttcaatacggtcatgctgcagctggtggctgcccagggccgggcagggagccccttccacccggccatggaagccctctccctgtcttctctgagtgagaaggatgaagccacacaagcctccgcagcattcctagtgtctctctacataaaggacatctggctgggggctcagcggccggacaccctcttaacccacgtccggatggtgtgtgaggccgcagatgatgccccgagcagtgaagaggaggccatcgtggtgctctgcaaggacgccgccagcgcagcctcagatgcttgactcctgccggccagcaccttgcaccctgatgaccagagcctcgagcacagcaccagcttctagaagtttggttgagtcaagggtttccagagaaggcatgggaaacaacaggttcagtacattggctcagttctttgacaagaaaagttgagaggactttattgaactgcccagtaaatgataaactcgggcctgtaggtgcccagcatcagagttgcaaggaatgtggggacttctaggccatgaggcccatccagtgcctcgtcaggccgccccttcctctctaggggcttggagctcatcacaggaaatagctcgagtttgaggcagcacttctgaatgcagaagagattcatctgtgttaaagctgaaatgtcaaaaggtatcagattttttttatgaaaacgaagagagatgtttaaagtttatttttcagcaggtgaggtggctcacgcctataatcccagcactttgggaggccaaggcgggtgaatcacctgaggtcaggagttcgaaaccagccttcccaacatggtgaaaccccatctctactaaaaatacaaaaattagccaggcatggtagcgcacacctgtaattccagctactcgggaggctaaggcaggggaatcgcttgaacctgggaggtggaggctacagtgagctgagatcgtgccattgcgctccagcctaggtgacagagcaagactccatctcaaaaaaataaaaaaataaagtttgtttttctataaaaagtcataacaaagtattagtatgactttttgaataagttaatttctgccagtgtttaattattttattaaagaaaaggatgttacactgaatccttaaagaataaaagtgatttgacctctgctttgagaagacagcctgtaatttttaaagctatacttcaaagaggggattttgaattttataaatgcttgttaatgtctatttttgtaaggtttttgtgttttcctttcattgttgttaagaggctatttttgctccacataggcctgcatttattttaaaggtcagaattttactcttaatggtcatatattagttggggttgtagctgacaaaagtcatgaaatttcgtggttttcacagttaaaatttccgtctgttcctttaaaactctcctgcatgcctggggctcttgggatctgctctgtggcctaggatgtggctgttttatctgccgtataatgtacatcgtgctgacaatgccttggttttgtctgaaacatttacacttctattttccaccagtgttctttagaattgtttctgttttaggtgacttaaagttttaactaaagcatgagtaacgtttgttggcatacagtcccttcaccacaaataattgtcttgcactgtctacaaagcaaggatcagttacctcacttgtccccttccctacccaaataaaccttacaacgctattctttgagactatcctgaacttgaaatcccacgtttagatccaagctggactcaggcaagcgctgctccaacaaagcgttctcttcctggttccccttaatctttatccacctctccaaggcctatctttggggattcctttggttataggcacctctgcttgtttatgcagggggcattggccggaaggacattggtctggggaatatccctgaaccccatgcctctgggggcacagggaggggcagcgagcaggtggggtggatttccacggcttcatccctggctccaggcctaagctgcctcccaggttcttagggcccagcaagtcaatacatactacgtcaggtggcgacaaatgctccaaagccgagttccagctcagtcaagtgaggacacattttcagcacctcaccttcttttctgcatctctggagctcatcagtcttgcttttctttgttctcccttttaaatccactgccctgaccttgttcatgtattttccagtcacttagtgtggaggaagggaatctcatcccatggagaatagatcgaacatggtcttcacctgacttaaaatataaaatgctaaattagaaatatcttaagtggggcggggggcacagttattttaaaaataaaacctatcaactccctccttgcctgaaagctgtaggggacatatgggtcttctgagatttgctgtgtgatgctgtctcctctccagggacaaggctgctgggcactagaggactagatctttcaagggtcccagatccactgtcacataaagtcacatccagaagacctttcctgccagcttccagggctctttgtgttctgtgacagcatttgggcatagatcctgcttacccggcctggctgctgacaggcgttggctgcctgccctccaggggagacactttcttgggctctgtctttgaaaggctgtggggaggttgaaggtgcaactcaggtccccagactgcagtgagctgacctggcagggcagatgccatcacatctgggggagccggcgggtgttagtggagcttggatgggaacttacccagcatcctaacaaaggtacagaaggaccaggtgaactcagggctgataacgcattacacagtaatggtaaagtggcatagtaaagattagtaagcaaacagcttttcctcttgatttgcatatattttattttcctactcttccctgagcaaatataagcagtaagcaagcaggctaggtgtgctcaataaactcagcaacacctgggatgacctctgcactcgaggggccactgcaatctttgtcaaaggcataggatgctcctgctctagttgcacttgacctaggtgccctttctgctacatgcaaatggcctctaagaagaacgaggaacgtatgtgtccaggttggcttgatttcaccagttcactcagctatggccacgatttactgacatcagctctgcaattgagaggtcctgtctccagggggaggctcgctgggcttgctcctgacgaggggacccccattgagggtcagttcccagaggagagtggggtgggtctggaaacccccgaggggcaaggtggaggagctctcctgtcgtagcggctggtcagggccagttctgctccctggctccactgagctcgcctgagcctgtgaggttgccaggggttccctgtggcacggcaggcacttctggatgcagaggtggaggttgaggccgtgactccaggggcatgtttggtggtgcttggggctgttcctgtgaacagagcagagtgggaggcaggcatcatagttgctgcagaacagtccatactgtggggctggggggtttcctgccacacctgccatctgcccggaccccatagggaaggccacacaggcaaattcctgagaagggtcagccagctcacaaaggtggccattctagagaaatctcagaggagaggaagtgctttgtcaggaactaggcctcaggtctttccctggaggccacttcttcctacattgatttaggatggggggggtggggggtggaggggagcaggttgacctcccatccagcgctgtatctgagtgtagttcattttatatccatagcccaagccaacttgtatcttggtgatatggtttggctgcgtcacgacacaaatctcaccttgaattgtaataatccccacgtgtcgtgggaaggacccagtgggaggtaattgaatcatgggggcgggtcttcccatgctgttctcgtgatagtaagtctcatgagatctgatggttttataaaggggagtttccctgcacatgcccttttgcctgtgtcatgtaagatgtggctttgctcttcctttgccttctgccatgactgtgaagcctcccccgccatgtgaaactgtgagtccattaaacctctttcctttataaatta

SEQ ID NO: 303476 - DNA, 4204 bp, Homo sapiens
gcccaggcctgtggcacggttcatttgggcacttggcaaagccgttgcattgtgggcaggatgacctgttttcgagctgagcaggtgtgcatcctaatggcctatcccctgctcttgttcagcctccgcagcattcctagtgtctctctacataaaggacatctggctgggggctcagcggccggacaccctcttaacccacgtccggatggtgtgtgaggccgcagatgatgccccgagcagtgaagaggaggccatcgtggtgctctgcaaggacgccgccagcgcagcctcagatgcttgactcctgccggccagcaccttgcaccctgatgaccagagcctcgagcacagcaccagcttctagaagtttggttgagtcaagggtttccagagaaggcatgggaaacaacaggttcagtacattggctcagttctttgacaagaaaagttgagaggactttattgaactgcccagtaaatgataaactcgggcctgtaggtgcccagcatcagagttgcaaggaatgtggggacttctaggccatgaggcccatccagtgcctcgtcaggccgccccttcctctctaggggcttggagctcatcacaggaaatagctcgagtttgaggcagcacttctgaatgcagaagagattcatctgtgttaaagctgaaatgtcaaaaggtatcagattttttttatgaaaacgaagagagatgtttaaagtttatttttcagcaggtgaggtggctcacgcctataatcccagcactttgggaggccaaggcgggtgaatcacctgaggtcaggagttcgaaaccagccttcccaacatggtgaaaccccatctctactaaaaatacaaaaattagccaggcatggtagcgcacacctgtaattccagctactcgggaggctaaggcaggggaatcgcttgaacctgggaggtggaggctacagtgagctgagatcgtgccattgcgctccagcctaggtgacagagcaagactccatctcaaaaaaataaaaaaataaagtttgtttttctataaaaagtcataacaaagtattagtatgactttttgaataagttaatttctgccagtgtttaattattttattaaagaaaaggatgttacactgaatccttaaagaataaaagtgatttgacctctgctttgagaagacagcctgtaatttttaaagctatacttcaaagaggggattttgaattttataaatgcttgttaatgtctatttttgtaaggtttttgtgttttcctttcattgttgttaagaggctatttttgctccacataggcctgcatttattttaaaggtcagaattttactcttaatggtcatatattagttggggttgtagctgacaaaagtcatgaaatttcgtggttttcacagttaaaatttccgtctgttcctttaaaactctcctgcatgcctggggctcttgggatctgctctgtggcctaggatgtggctgttttatctgccgtataatgtacatcgtgctgacaatgccttggttttgtctgaaacatttacacttctattttccaccagtgttctttagaattgtttctgttttaggtgacttaaagttttaactaaagcatgagtaacgtttgttggcatacagtcccttcaccacaaataattgtcttgcactgtctacaaagcaaggatcagttacctcacttgtccccttccctacccaaataaaccttacaacgctattctttgagactatcctgaacttgaaatcccacgtttagatccaagctggactcaggcaagcgctgctccaacaaagcgttctcttcctggttccccttaatctttatccacctctccaaggcctatctttggggattcctttggttataggcacctctgcttgtttatgcagggggcattggccggaaggacattggtctggggaatatccctgaaccccatgcctctgggggcacagggaggggcagcgagcaggtggggtggatttccacggcttcatccctggctccaggcctaagctgcctcccaggttcttagggcccagcaagtcaatacatactacgtcaggtggcgacaaatgctccaaagccgagttccagctcagtcaagtgaggacacattttcagcacctcaccttcttttctgcatctctggagctcatcagtcttgcttttctttgttctcccttttaaatccactgccctgaccttgttcatgtattttccagtcacttagtgtggaggaagggaatctcatcccatggagaatagatcgaacatggtcttcacctgacttaaaatataaaatgctaaattagaaatatcttaagtggggcggggggcacagttattttaaaaataaaacctatcaactccctccttgcctgaaagctgtaggggacatatgggtcttctgagatttgctgtgtgatgctgtctcctctccagggacaaggctgctgggcactagaggactagatctttcaagggtcccagatccactgtcacataaagtcacatccagaagacctttcctgccagcttccagggctctttgtgttctgtgacagcatttgggcatagatcctgcttacccggcctggctgctgacaggcgttggctgcctgccctccaggggagacactttcttgggctctgtctttgaaaggctgtggggaggttgaaggtgcaactcaggtccccagactgcagtgagctgacctggcagggcagatgccatcacatctgggggagccggcgggtgttagtggagcttggatgggaacttacccagcatcctaacaaaggtacagaaggaccaggtgaactcagggctgataacgcattacacagtaatggtaaagtggcatagtaaagattagtaagcaaacagcttttcctcttgatttgcatatattttattttcctactcttccctgagcaaatataagcagtaagcaagcaggctaggtgtgctcaataaactcagcaacacctgggatgacctctgcactcgaggggccactgcaatctttgtcaaaggcataggatgctcctgctctagttgcacttgacctaggtgccctttctgctacatgcaaatggcctctaagaagaacgaggaacgtatgtgtccaggttggcttgatttcaccagttcactcagctatggccacgatttactgacatcagctctgcaattgagaggtcctgtctccagggggaggctcgctgggcttgctcctgacgaggggacccccattgagggtcagttcccagaggagagtggggtgggtctggaaacccccgaggggcaaggtggaggagctctcctgtcgtagcggctggtcagggccagttctgctccctggctccactgagctcgcctgagcctgtgaggttgccaggggttccctgtggcacggcaggcacttctggatgcagaggtggaggttgaggccgtgactccaggggcatgtttggtggtgcttggggctgttcctgtgaacagagcagagtgggaggcaggcatcatagttgctgcagaacagtccatactgtggggctggggggtttcctgccacacctgccatctgcccggaccccatagggaaggccacacaggcaaattcctgagaagggtcagccagctcacaaaggtggccattctagagaaatctcagaggagaggaagtgctttgtcaggaactaggcctcaggtctttccctggaggccacttcttcctacattgatttaggatggggggggtggggggtggaggggagcaggttgacctcccatccagcgctgtatctgagtgtagttcattttatatccatagcccaagccaacttgtatcttggtgatatggtttggctgcgtcacgacacaaatctcaccttgaattgtaataatccccacgtgtcgtgggaaggacccagtgggaggtaattgaatcatgggggcgggtcttcccatgctgttctcgtgatagtaagtctcatgagatctgatggttttataaaggggagtttccctgcacatgcccttttgcctgtgtcatgtaagatgtggctttgctcttcctttgccttctgccatgactgtgaagcctcccccgccatgtgaaactgtgagtccattaaacctctttcctttataaatta

SEQ ID NO: 303477 - DNA, 8780 bp, Homo sapiens
cgcgcccgcaaagaagagctcacgggcgtgcggttcaaggctcagctgaaggacccgcagggccccgggccaggcttggaagcgtttgtgtctgctgccaagaagctaccacgagaagatgtgtatgatgttgtggaagggtatataaagatttctgttgagtgtgtcgaaattttccagctcctaagtggagagaaacgacctgaaagtgaaacgatgttaatatttcaagttttcgaggccatattattgcggacagcaagtgatctttcacatttccatgttgtgggaaccaacattgtgaaaaagctgatgaacaaccacatgaagctcatctgtgagtccctgtatgcctcaggttacaggttggctcgcgcctgcctgagcctgatgaccgccatggtgacccagggtccggaagctgccagggacgtctgcagccattttgatttgaataaaaagaccctgtacaccctggtgaccaagagggattcaaagggagtgtacgacgttcggcaggcctacgttcagtttgctctctcctttttaattgcgggtgatgacagcactatagtgcaggtgttggaagtgaaagaatttattccttgcatttttagctcagggataaaggaagataggatctctaccatcaatattttattatccacactgaaaacaaaggtagttcacaataaaaatatcacaaaaacccagaaggtgcgtttctttacggggcagttattgaaccacatagcatcgctgtacaactggaatgggattaccgatgtgaacccagaaaatgtcaaggtttctgccgaagaagcagggaaaaccatggtgcgggagcttgttcataacttcctgatggatctttgctgttcactcaagcatggaattaatttttacgatgcatctttgggtacctttggcagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaagatctatgaggctcagccggagatttcccgggcatttcagaccagagagtttatacccttgcctcggctcctggcaatggtgatggtgaccaccgtgcccctggtgtgcaataagagcatgttcacccaagcattaaacttggacagcacctcagtgaggcacacagccttatcccttatttctgtcattttgaagagggcattaaaaactgttgaccactgcctgaataaagaggtgtggcaggaatcaggcgtgtacacagctgtgatgatggaagaattcgtgcagctcttcagagaagccctgagcaagattttgccagacctgaacactgtcgtgtgggtctggcagtcacttaaaaagcaagagaccaaacaggatgacaagaaagggcagaaaaggagcgatgggcccccggctgcctgcgatgctcaccagtgcgatgatgcagaaaccattcttttgaaagctgttttgctccaggtcatatgcctctaccagaaggtggtcccccacgtggtcatgcagtacaactttgacttcagcaagctcctgaaaggtgtcatctctgagcagggccttcgagaggaggtgcctcccattctgcagcaccacatgctgaaggtggccctggagctgccggccagcaagtttctgtggttaaaggcacaggaaggcccagatgcagaaattattggaggtgaacgatcagtattttacttactaatgaaaatgtttgtgaccagtagccatttacaactgaagtcattgaccaaacttctgatcatgaagattctgcgggacacgggggtgtttgagcacacctggaaggagctggagctctggctggagcatttagagaacaccatggaagaggacaaagagactgtgattcagtttctggaacgcattttattgacattggtggcgaatccctattcatacacagacaaagcatctgactttgtccaagaagcaagcatgctgcaggccactatgacgaagcaagaagccgatgacatgagcattcccatctcccacattgacgatgttctcgacatggtggatgtcctggtggagggcagtgaaggcttggatgaggaaatagggttcacgttgagtgaagacatgatcctgctcacgttcccattcagtgcggtagtccctgcggccctggaagccaggaataagttgctccttgggacaggcaatgaagcagcggaaaacgttgtgacatatctgacggcagtgctgactgacctcctccacacccagagggaccccctggctctgtgtctcctgctccaggcatatgataagcttgagcctccatgcctggtgccttgctgccagcagctctcacggtttaacagatactacagcctctggatcccggagcaagcccgagaggcctggctgctgcaggcacagggcagcccctcgccccctgcccttcccttggcctcgtccttcacagccctgctgcaggcagcctacgagagccaagcgcttcgggacgagcacatccaggtgcagctgcaggccaccatgccacacctgtccatgcagcaggtcctgctcgcggccaagcaggtgttgctctacctgcggagcactgtggagaacttcggccagctgggcagaagtgtgggcccgcccctcctgcagctcttcctggatctcctcaggcgcctggttgtccactgtgagcagctggatgcccagaaccagcagagatgcgaggccgcccgggccgaagccgacctcttcctggacatggagtccgtggcctcgctggagttggccaatgatcagacgctggaggaggtgcttgtggccatcctcaggcaccccaccctggagggctggttcctggccctggagcagcaggccctcccgccgcacacgctcagccctgtcctcgtgaagctcctggccacccactttagtgcaggggtccttcagctgctggcagcaagtgccccgatcctccagaacattgggcagctgggccttctggccaggtactcagaggccatcacccagagtgtgctgaaggaacttcagaacaggagggcgggcccggccacatcaccaccaaagaccccgccgcagctggaggccctgcaggagctgcatccatacatggagggtgcccagctccgtgaggtcaccctggccttgctgagcctgcctgagacacacctggtgacccagcaacccacgaaatcccccgggaaggaaagacacctgaatgctcttggaaagaccctggtgcagctgctgacctgcagcccccaggatcagctgcagagtggtgagctcctgtggtcctccgagtatgtgagaggcctgggggctctgctgcccacgctagcagtggacgagctggacacagtgctcctccacactctgcagagagaccctgtgctggcccccgcagtcggggctgatctgcttgactactgcctggcccggcgcacacaggcggccctcagcatcgctgccctgctcctccaggagagctgcacccacttgctgtggttcgagcagtggtgcctgcaggctggcccagggctcggcctccagggggacctggacgacttccttcccctcatccatgtgtacctccagtgcaggacacggagccacttcacacgcccagcaggagtgtcttccgctgtcattcctgtcttgaggaagaccctgtggaggcagctacagagcaggcttcttagcactgacagtcccccagcatctgggctgtaccaggagatcctggcacagctggtcccgtttgcacgagccaaggatctcagtgtactcatggaccgcctgcccagcttgcttcacaccccaagcagtcacaagaggtggatcgtggccgactccatttcagcagctctggaagggtcagcagaagagctgtgtgcctggagaaggacccttttggagtcctgtgtgaagtggctgatcgtgtctttcagtggtggacagcaagatgatgataatactcagaatcaggagaaggaaatgctgcttagattaaatgcgttgttgcatgcacttaatgaagttgatcctggtgactggcagaaattcgtgaagaagggactcaaatttcggtaccaggaccacacatttttaaagatgctcctcaccgccgtacagctcctgtacagcccagaaagctccgtgcgcacgaagctcatccagctcccggtggtctacgtgatgctcatgcagcactcgctgtttctgccgactctactgacgtctgacggagaggagagcccggacagccaagtaaaagaagcgctggtggacctgatgctgacggtggtggagatgtgcccctctgtctgtgagagcagccactttgcagtgcttctcggggcctatggcgccactctcagcgtcctagatcagaagattttacttctgcttcgagcgtatgagcagaacaagctcagcctcatcaacttcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccagagtttgtggtggattgtcgaaaatttttggattcaaatgctctgggcctaactgtcacagccctcagcagctatgacccccagatgcgagccatagcctaccatgtcctggcggcctactactcgcacttggagggcgcacggttccaagagcagtcccagctactttacctgttggatgtagtccggaatgggattcgaactcaggacatgagacttacttttaccttggctctcttcattgccaaagcagccctgcagattttgaaaccagaggagcacatgtacctgaaggtcagcaacttcctgctgtcgcatgagtacttgaacatggacaaagtgccaggcttctaccagttcttctacagctccgactttgagcaaaaaacagagcagaagtgggtgtttggccttctgcggcaggggatccgtgacaagcagtgctacgaactgtgtgcccggcgtggcatcttccacatcatcctgtccttcttccacagcccgctgtgtgacgaggcagcacagaattggattctggaaattctacagaatgctgcccaggttgccagatctgcgtatgaaatcatacgagactatagccttttaacatggattttacacatccttgaaagcaagtggaggctacagtgagctgagatcgtgccattgcgctccagcctaggtgacagagcaagactccatctcaaaaaaataaaaaaataaagtttgtttttctataaaaagtcataacaaagtattagtatgactttttgaataagttaatttctgccagtgtttaattattttattaaagaaaaggatgttacactgaatccttaaagaataaaagtgatttgacctctgctttgagaagacagcctgtaatttttaaagctatacttcaaagaggggattttgaattttataaatgcttgttaatgtctatttttgtaaggtttttgtgttttcctttcattgttgttaagaggctatttttgctccacataggcctgcatttattttaaaggtcagaattttactcttaatggtcatatattagttggggttgtagctgacaaaagtcatgaaatttcgtggttttcacagttaaaatttccgtctgttcctttaaaactctcctgcatgcctggggctcttgggatctgctctgtggcctaggatgtggctgttttatctgccgtataatgtacatcgtgctgacaatgccttggttttgtctgaaacatttacacttctattttccaccagtgttctttagaattgtttctgttttaggtgacttaaagttttaactaaagcatgagtaacgtttgttggcatacagtcccttcaccacaaataattgtcttgcactgtctacaaagcaaggatcagttacctcacttgtccccttccctacccaaataaaccttacaacgctattctttgagactatcctgaacttgaaatcccacgtttagatccaagctggactcaggcaagcgctgctccaacaaagcgttctcttcctggttccccttaatctttatccacctctccaaggcctatctttggggattcctttggttataggcacctctgcttgtttatgcagggggcattggccggaaggacattggtctggggaatatccctgaaccccatgcctctgggggcacagggaggggcagcgagcaggtggggtggatttccacggcttcatccctggctccaggcctaagctgcctcccaggttcttagggcccagcaagtcaatacatactacgtcaggtggcgacaaatgctccaaagccgagttccagctcagtcaagtgaggacacattttcagcacctcaccttcttttctgcatctctggagctcatcagtcttgcttttctttgttctcccttttaaatccactgccctgaccttgttcatgtattttccagtcacttagtgtggaggaagggaatctcatcccatggagaatagatcgaacatggtcttcacctgacttaaaatataaaatgctaaattagaaatatcttaagtggggcggggggcacagttattttaaaaataaaacctatcaactccctccttgcctgaaagctgtaggggacatatgggtcttctgagatttgctgtgtgatgctgtctcctctccagggacaaggctgctgggcactagaggactagatctttcaagggtcccagatccactgtcacataaagtcacatccagaagacctttcctgccagcttccagggctctttgtgttctgtgacagcatttgggcatagatcctgcttacccggcctggctgctgacaggcgttggctgcctgccctccaggggagacactttcttgggctctgtctttgaaaggctgtggggaggttgaaggtgcaactcaggtccccagactgcagtgagctgacctggcagggcagatgccatcacatctgggggagccggcgggtgttagtggagcttggatgggaacttacccagcatcctaacaaaggtacagaaggaccaggtgaactcagggctgataacgcattacacagtaatggtaaagtggcatagtaaagattagtaagcaaacagcttttcctcttgatttgcatatattttattttcctactcttccctgagcaaatataagcagtaagcaagcaggctaggtgtgctcaataaactcagcaacacctgggatgacctctgcactcgaggggccactgcaatctttgtcaaaggcataggatgctcctgctctagttgcacttgacctaggtgccctttctgctacatgcaaatggcctctaagaagaacgaggaacgtatgtgtccaggttggcttgatttcaccagttcactcagctatggccacgatttactgacatcagctctgcaattgagaggtcctgtctccagggggaggctcgctgggcttgctcctgacgaggggacccccattgagggtcagttcccagaggagagtggggtgggtctggaaacccccgaggggcaaggtggaggagctctcctgtcgtagcggctggtcagggccagttctgctccctggctccactgagctcgcctgagcctgtgaggttgccaggggttccctgtggcacggcaggcacttctggatgcagaggtggaggttgaggccgtgactccaggggcatgtttggtggtgcttggggctgttcctgtgaacagagcagagtgggaggcaggcatcatagttgctgcagaacagtccatactgtggggctggggggtttcctgccacacctgccatctgcccggaccccatagggaaggccacacaggcaaattcctgagaagggtcagccagctcacaaaggtggccattctagagaaatctcagaggagaggaagtgctttgtcaggaactaggcctcaggtctttccctggaggccacttcttcctacattgatttaggatggggggggtggggggtggaggggagcaggttgacctcccatccagcgctgtatctgagtgtagttcattttatatccatagcccaagccaacttgtatcttggtgatatggtttggctgcgtcacgacacaaatctcaccttgaattgtaataatccccacgtgtcgtgggaaggacccagtgggaggtaattgaatcatgggggcgggtcttcccatgctgttctcgtgatagtaagtctcatgagatctgatggttttataaaggggagtttccctgcacatgcccttttgcctgtgtcatgtaagatgtggctttgctcttcctttgccttctgccatgactgtgaagcctcccccgccatgtgaaactgtgagtccattaaacctctttcctttataaatta

SEQ ID NO: 303478 - DNA, 5585 bp, Homo sapiens
cgcgcccgcaaagaagagctcacgggcgtgcggttcaaggctcagctgaaggacccgcagggccccgggccaggcttggaagcgtttgtgtctgctgccaagaagctaccacgagaagatgtgtatgatgttgtggaagggtatataaagatttctgttgagtgtgtcgaaattttccagctcctaagtggagagaaacgacctgaaagtgaaacgatgttaatatttcaagttttcgaggccatattattgcggacagcaagtgatctttcacatttccatgttgtgggaaccaacattgtgaaaaagctgatgaacaaccacatgaagctcatctgtgagtccctgtatgcctcaggttacaggttggctcgcgcctgcctgagcctgatgaccgccatggtgacccagggtccggaagctgccagggacgtctgcagccattttgatttgaataaaaagaccctgtacaccctggtgaccaagagggattcaaagggagtgtacgacgttcggcaggcctacgttcagtttgctctctcctttttaattgcgggtgatgacagcactatagtgcaggtgttggaagtgaaagaatttattccttgcatttttagctcagggataaaggaagataggatctctaccatcaatattttattatccacactgaaaacaaaggtagttcacaataaaaatatcacaaaaacccagaaggtgcgtttctttacggggcagttattgaaccacatagcatcgctgtacaactggaatgggattaccgatgtgaacccagaaaatgtcaaggtttctgccgaagaagcagggaaaaccatggtgcgggagcttgttcataacttcctgatggatctttgctgttcactcaagcatggaattaatttttacgatgcatctttgggtacctttggcagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaagatctatgaggctcagccggagatttcccgggcatttcagaccagagagtttatacccttgcctcggctcctggcaatggtgatggtgaccaccgtgcccctggtgtgcaataagagcatgttcacccaagcattaaacttggacagcacctcagtgaggcacacagccttatcccttatttctgtcattttgaagagggcattaaaaactgttgaccactgcctgaataaagaggtgtggcaggaatcaggcgtgtacacagctgtgatgatggaagaattcgtgcagctcttcagagaagccctgagcaagattttgccagacctgaacactgtcgtgtgggtctggcagtcacttaaaaagcaagagaccaaacaggatgacaagaaagggcagaaaaggagcgatgggcccccggctgcctgcgatgctcaccagtgcgatgatgcagaaaccattcttttgaaagctgttttgctccaggtcatatgcctctaccagaaggtggtcccccacgtggtcatgcagtacaactttgacttcagcaagctcctgaaaggtgtcatctctgagcagggccttcgagaggaggtgcctcccattctgcagcaccacatgctgaaggtggccctggagctgccggccagcaagtttctgtggttaaaggcacaggaaggcccagatgcagaaattattggaggtgaacgatcagtattttacttactaatgaaaatgtttgtgaccagtagccatttacaactgaagtcattgaccaaacttctgatcatgaagattctgcgggacacgggggtgtttgagcacacctggaaggagctggagctctggctggagcatttagagaacaccatggaagaggacaaagagactgtgattcagtttctggaacgcattttattgacattggtggcgaatccctattcatacacagacaaagcatctgactttgtccaagaagcaagcatgctgcaggccactatgacgaagcaagaagccgatgacatgagcattcccatctcccacattgacgatgttctcgacatggtggatgtcctggtggagggcagtgaaggcttggatgaggaaatagggttcacgttgagtgaagacatgatcctgctcacgttcccattcagtgcggtagtccctgcggccctggaagccaggaataagttgctccttgggacaggcaatgaagcagcggaaaacgttgtgacatatctgacggcagtgctgactgacctcctccacacccagagggaccccctggctctgtgtctcctgctccaggcatatgataagcttgagcctccatgcctggtgccttgctgccagcagctctcacggtttaacagatactacagcctctggatcccggagcaagcccgagaggcctggctgctgcaggcacagggcagcccctcgccccctgcccttcccttggcctcgtccttcacagccctgctgcaggcagcctacgagagccaagcgcttcgggacgagcacatccaggtgcagctgcaggccaccatgccacacctgtccatgcagcaggtcctgctcgcggccaagcaggtgttgctctacctgcggagcactgtggagaacttcggccagctgggcagaagtgtgggcccgcccctcctgcagctcttcctggatctcctcaggcgcctggttgtccactgtgagcagctggatgcccagaaccagcagagatgcgaggccgcccgggccgaagccgacctcttcctggacatggagtccgtggcctcgctggagttggccaatgatcagacgctggaggaggtgcttgtggccatcctcaggcaccccaccctggagggctggttcctggccctggagcagcaggccctcccgccgcacacgctcagccctgtcctcgtgaagctcctggccacccactttagtgcaggggtccttcagctgctggcagcaagtgccccgatcctccagaacattgggcagctgggccttctggccaggtactcagaggccatcacccagagtgtgctgaaggaacttcagaacaggagggcgggcccggccacatcaccaccaaagaccccgccgcagctggaggccctgcaggagctgcatccatacatggagggtgcccagctccgtgaggtcaccctggccttgctgagcctgcctgagacacacctggtgacccagcaacccacgaaatcccccgggaaggaaagacacctgaatgctcttggaaagaccctggtgcagctgctgacctgcagcccccaggatcagctgcagagtggtgagctcctgtggtcctccgagtatgtgagaggcctgggggctctgctgcccacgctagcagtggacgagctggacacagtgctcctccacactctgcagagagaccctgtgctggcccccgcagtcggggctgatctgcttgactactgcctggcccggcgcacacaggcggccctcagcatcgctgccctgctcctccaggagagctgcacccacttgctgtggttcgagcagtggtgcctgcaggctggcccagggctcggcctccagggggacctggacgacttccttcccctcatccatgtgtacctccagtgcaggacacggagccacttcacacgcccagcaggagtgtcttccgctgtcattcctgtcttgaggaagaccctgtggaggcagctacagagcaggcttcttagcactgacagtcccccagcatctgggctgtaccaggagatcctggcacagctggtcccgtttgcacgagccaaggatctcagtgtactcatggaccgcctgcccagcttgcttcacaccccaagcagtcacaagaggtggatcgtggccgactccatttcagcagctctggaagggtcagcagaagagctgtgtgcctggagaaggacccttttggagtcctgtgtgaagtggctgatcgtgtctttcagtggtggacagcaagatgatgataatactcagaatcaggagaaggaaatgctgcttagattaaatgcgttgttgcatgcacttaatgaagttgatcctggtgactggcagaaattcgtgaagaagggactcaaatttcggtaccaggaccacacatttttaaagatgctcctcaccgccgtacagctcctgtacagcccagaaagctccgtgcgcacgaagctcatccagctcccggtggtctacgtgatgctcatgcagcactcgctgtttctgccgactctactgacgtctgacggagaggagagcccggacagccaagtaaaagaagcgctggtggacctgatgctgacggtggtggagatgtgcccctctgtctgtgagagcagccactttgcagtgcttctcggggcctatggcgccactctcagcgtcctagatcagaagattttacttctgcttcgagcgtatgagcagaacaagctcagcctcatcaacttcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccagagtttgtggtggattgtcgaaaatttttggattcaaatgctctgggcctaactgtcacagccctcagcagctatgacccccagatgcgagccatagcctaccatgtcctggcggcctactactcgcacttggagggcgcacggttccaagagcagtcccagctactttacctgttggatgtagtccggaatgggattcgaactcaggacatgagacttacttttaccttggctctcttcattgccaaagcagccctgcagattttgaaaccagaggagcacatgtacctgaaggtcagcaacttcctgctgtcgcatgagtacttgaacatggacaaagtgccaggcttctaccagttcttctacagctccgactttgaggtatgcttccagagtcctcacggctttctgcaggcccctgaattgatgatgcagccaccgttgtcattctgacatttccccatggatcctgtatgctgcacggccaacacgattgtgcagtcggtggccacgcaggcctgcacttcggaatgtctccgtgctgttggctcacttctacatggcgcctcaaaccttaaaaactctgcttcagagtcctgagttttacgacattctcatattttcttggtgaatcactgggttaaatattaaattctgtttttagatattcatattaaatattcttttatagaata

SEQ ID NO: 303479 - DNA, 5813 bp, Homo sapiens
cgcgcccgcaaagaagagctcacgggcgtgcggttcaaggctcagctgaaggacccgcagggccccgggccaggcttggaagcgtttgtgtctgctgccaagaagctaccacgagaagatgtgtatgatgttgtggaagggtatataaagatttctgttgagtgtgtcgaaattttccagctcctaagtggagagaaacgacctgaaagtgaaacgatgttaatatttcaagttttcgaggccatattattgcggacagcaagtgatctttcacatttccatgttgtgggaaccaacattgtgaaaaagctgatgaacaaccacatgaagctcatctgtgagtccctgtatgcctcaggttacaggttggctcgcgcctgcctgagcctgatgaccgccatggtgacccagggtccggaagctgccagggacgtctgcagccattttgatttgaataaaaagaccctgtacaccctggtgaccaagagggattcaaagggagtgtacgacgttcggcaggcctacgttcagtttgctctctcctttttaattgcgggtgatgacagcactatagtgcaggtgttggaagtgaaagaatttattccttgcatttttagctcagggataaaggaagataggatctctaccatcaatattttattatccacactgaaaacaaaggtagttcacaataaaaatatcacaaaaacccagaaggtgcgtttctttacggggcagttattgaaccacatagcatcgctgtacaactggaatgggattaccgatgtgaacccagaaaatgtcaaggtttctgccgaagaagcagggaaaaccatggtgcgggagcttgttcataacttcctgatggatctttgctgttcactcaagcatggaattaatttttacgatgcatctttgggtacctttggcagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaagatctatgaggctcagccggagatttcccgggcatttcagaccagagagtttatacccttgcctcggctcctggcaatggtgatggtgaccaccgtgcccctggtgtgcaataagagcatgttcacccaagcattaaacttggacagcacctcagtgaggcacacagccttatcccttatttctgtcattttgaagagggcattaaaaactgttgaccactgcctgaataaagaggtgtggcaggaatcaggcgtgtacacagctgtgatgatggaagaattcgtgcagctcttcagagaagccctgagcaagattttgccagacctgaacactgtcgtgtgggtctggcagtcacttaaaaagcaagagaccaaacaggatgacaagaaagggcagaaaaggagcgatgggcccccggctgcctgcgatgctcaccagtgcgatgatgcagaaaccattcttttgaaagctgttttgctccaggtcatatgcctctaccagaaggtggtcccccacgtggtcatgcagtacaactttgacttcagcaagctcctgaaaggtgtcatctctgagcagggccttcgagaggaggtgcctcccattctgcagcaccacatgctgaaggtggccctggagctgccggccagcaagtttctgtggttaaaggcacaggaaggcccagatgcagaaattattggaggtgaacgatcagtattttacttactaatgaaaatgtttgtgaccagtagccatttacaactgaagtcattgaccaaacttctgatcatgaagattctgcgggacacgggggtgtttgagcacacctggaaggagctggagctctggctggagcatttagagaacaccatggaagaggacaaagagactgtgattcagtttctggaacgcattttattgacattggtggcgaatccctattcatacacagacaaagcatctgactttgtccaagaagcaagcatgctgcaggccactatgacgaagcaagaagccgatgacatgagcattcccatctcccacattgacgatgttctcgacatggtggatgtcctggtggagggcagtgaaggcttggatgaggaaatagggttcacgttgagtgaagacatgatcctgctcacgttcccattcagtgcggtagtccctgcggccctggaagccaggaataagttgctccttgggacaggcaatgaagcagcggaaaacgttgtgacatatctgacggcagtgctgactgacctcctccacacccagagggaccccctggctctgtgtctcctgctccaggcatatgataagcttgagcctccatgcctggtgccttgctgccagcagctctcacggtttaacagatactacagcctctggatcccggagcaagcccgagaggcctggctgctgcaggcacagggcagcccctcgccccctgcccttcccttggcctcgtccttcacagccctgctgcaggcagcctacgagagccaagcgcttcgggacgagcacatccaggtgcagctgcaggccaccatgccacacctgtccatgcagcaggtcctgctcgcggccaagcaggtgttgctctacctgcggagcactgtggagaacttcggccagctgggcagaagtgtgggcccgcccctcctgcagctcttcctggatctcctcaggcgcctggttgtccactgtgagcagctggatgcccagaaccagcagagatgcgaggccgcccgggccgaagccgacctcttcctggacatggagtccgtggcctcgctggagttggccaatgatcagacgctggaggaggtgcttgtggccatcctcaggcaccccaccctggagggctggttcctggccctggagcagcaggccctcccgccgcacacgctcagccctgtcctcgtgaagctcctggccacccactttagtgcaggggtccttcagctgctggcagcaagtgccccgatcctccagaacattgggcagctgggccttctggccaggtactcagaggccatcacccagagtgtgctgaaggaacttcagaacaggagggcgggcccggccacatcaccaccaaagaccccgccgcagctggaggccctgcaggagctgcatccatacatggagggtgcccagctccgtgaggtcaccctggccttgctgagcctgcctgagacacacctggtgacccagcaacccacgaaatcccccgggaaggaaagacacctgaatgctcttggaaagaccctggtgcagctgctgacctgcagcccccaggatcagctgcagagtggtgagctcctgtggtcctccgagtatgtgagaggcctgggggctctgctgcccacgctagcagtggacgagctggacacagtgctcctccacactctgcagagagaccctgtgctggcccccgcagtcggggctgatctgcttgactactgcctggcccggcgcacacaggcggccctcagcatcgctgccctgctcctccaggagagctgcacccacttgctgtggttcgagcagtggtgcctgcaggctggcccagggctcggcctccagggggacctggacgacttccttcccctcatccatgtgtacctccagtgcaggacacggagccacttcacacgcccagcaggagtgtcttccgctgtcattcctgtcttgaggaagaccctgtggaggcagctacagagcaggcttcttagcactgacagtcccccagcatctgggctgtaccaggagatcctggcacagctggtcccgtttgcacgagccaaggatctcagtgtactcatggaccgcctgcccagcttgcttcacaccccaagcagtcacaagaggtggatcgtggccgactccatttcagcagctctggaagggtcagcagaagagctgtgtgcctggagaaggacccttttggagtcctgtgtgaagtggctgatcgtgtctttcagtggtggacagcaagatgatgataatactcagaatcaggagaaggaaatgctgcttagattaaatgcgttgttgcatgcacttaatgaagttgatcctggtgactggcagaaattcgtgaagaagggactcaaatttcggtaccaggaccacacatttttaaagatgctcctcaccgccgtacagctcctgtacagcccagaaagctccgtgcgcacgaagctcatccagctcccggtggtctacgtgatgctcatgcagcactcgctgtttctgccgactctactgacgtctgacggagaggagagcccggacagccaagtaaaagaagcgctggtggacctgatgctgacggtggtggagatgtgcccctctgtctgtgagagcagccactttgcagtgcttctcggggcctatggcgccactctcagcgtcctagatcagaagattttacttctgcttcgagcgtatgagcagaacaagctcagcctcatcaacttcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccagagtttgtggtggattgtcgaaaatttttggattcaaatgctctgggcctaactgtcacagccctcagcagctatgacccccagatgcgagccatagcctaccatgtcctggcggcctactactcgcacttggagggcgcacggttccaagagcagtcccagctactttacctgttggatgtagtccggaatgggattcgaactcaggacatgagacttacttttaccttggctctcttcattgccaaagcagccctgcagattttgaaaccagaggagcacatgtacctgaaggtcagcaacttcctgctgtcgcatgagtacttgaacatggacaaagtgccaggcttctaccagttcttctacagctccgactttgagcaaaaaacagagcagaagtgggtgtttggccttctgcggcaggggatccgtgacaagcagtgctacgaactgtgtgcccggcgtggcatcttccacatcatcctgtccttcttccacagcccgctgtgtgacgaggcagcacagaattggattctggaaattctacagaatgctgcccaggttgccagatctgcgtatgaaatcatacgagactatagccttttaacatggattttacacatccttgaaagcaattctggagactccgctgctgtctaaatgcaatcatgattgcatttagactatggtgagctcaggtgattgatactcctgatgcgagtaatacggatgtgtttaggagtgggacttctaggggatttagcggggtgatgcctgttgggggccagtgccctcctaattggggggtaggggctaggctggagtggtaaaaggctcagaaaaatcctgcgaagaaaaaaacttctgaggtaataaataggattatcctcgtatcgaagcctttttgacagctggtgtgtgtg

SEQ ID NO: 303480 - DNA, 5095 bp, Homo sapiens
cgcgcccgcaaagaagagctcacgggcgtgcggttcaaggctcagctgaaggacccgcagggccccgggccaggcttggaagcgtttgtgtctgctgccaagaagctaccacgagaagatgtgtatgatgttgtggaagggtatataaagatttctgttgagtgtgtcgaaattttccagctcctaagtggagagaaacgacctgaaagtgaaacgatgttaatatttcaagttttcgaggccatattattgcggacagcaagtgatctttcacatttccatgttgtgggaaccaacattgtgaaaaagctgatgaacaaccacatgaagctcatctgtgagtccctgtatgcctcaggttacaggttggctcgcgcctgcctgagcctgatgaccgccatggtgacccagggtccggaagctgccagggacgtctgcagccattttgatttgaataaaaagaccctgtacaccctggtgaccaagagggattcaaagggagtgtacgacgttcggcaggcctacgttcagtttgctctctcctttttaattgcgggtgatgacagcactatagtgcaggtgttggaagtgaaagaatttattccttgcatttttagctcagggataaaggaagataggatctctaccatcaatattttattatccacactgaaaacaaaggtagttcacaataaaaatatcacaaaaacccagaaggtgcgtttctttacggggcagttattgaaccacatagcatcgctgtacaactggaatgggattaccgatgtgaacccagaaaatgtcaaggtttctgccgaagaagcagggaaaaccatggtgcgggagcttgttcataacttcctgatggatctttgctgttcactcaagcatggaattaatttttacgatgcatctttgggtacctttggcagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaagatctatgaggctcagccggagatttcccgggcatttcagaccagagagtttatacccttgcctcggctcctggcaatggtgatggtgaccaccgtgcccctggtgtgcaataagagcatgttcacccaagcattaaacttggacagcacctcagtgaggcacacagccttatcccttatttctgtcattttgaagagggcattaaaaactgttgaccactgcctgaataaagaggtgtggcaggaatcaggcgtgtacacagctgtgatgatggaagaattcgtgcagctcttcagagaagccctgagcaagattttgccagacctgaacactgtcgtgtgggtctggcagtcacttaaaaagcaagagaccaaacaggatgacaagaaagggcagaaaaggagcgatgggcccccggctgcctgcgatgctcaccagtgcgatgatgcagaaaccattcttttgaaagctgttttgctccaggtcatatgcctctaccagaaggtggtcccccacgtggtcatgcagtacaactttgacttcagcaagctcctgaaaggtgtcatctctgagcagggccttcgagaggaggtgcctcccattctgcagcaccacatgctgaaggtggccctggagctgccggccagcaagtttctgtggttaaaggcacaggaaggcccagatgcagaaattattggaggtgaacgatcagtattttacttactaatgaaaatgtttgtgaccagtagccatttacaactgaagtcattgaccaaacttctgatcatgaagattctgcgggacacgggggtgtttgagcacacctggaaggagctggagctctggctggagcatttagagaacaccatggaagaggacaaagagactgtgattcagtttctggaacgcattttattgacattggtggcgaatccctattcatacacagacaaagcatctgactttgtccaagaagcaagcatgctgcaggccactatgacgaagcaagaagccgatgacatgagcattcccatctcccacattgacgatgttctcgacatggtggatgtcctggtggagggcagtgaaggcttggatgaggaaatagggttcacgttgagtgaagacatgatcctgctcacgttcccattcagtgcggtagtccctgcggccctggaagccaggaataagttgctccttgggacaggcaatgaagcagcggaaaacgttgtgacatatctgacggcagtgctgactgacctcctccacacccagagggaccccctggctctgtgtctcctgctccaggcatatgataagcttgagcctccatgcctggtgccttgctgccagcagctctcacggtttaacagatactacagcctctggatcccggagcaagcccgagaggcctggctgctgcaggcacagggcagcccctcgccccctgcccttcccttggcctcgtccttcacagccctgctgcaggcagcctacgagagccaagcgcttcgggacgagcacatccaggtgcagctgcaggccaccatgccacacctgtccatgcagcaggtcctgctcgcggccaagcaggtgttgctctacctgcggagcactgtggagaacttcggccagctgggcagaagtgtgggcccgcccctcctgcagctcttcctggatctcctcaggcgcctggttgtccactgtgagcagctggatgcccagaaccagcagagatgcgaggccgcccgggccgaagccgacctcttcctggacatggagtccgtggcctcgctggagttggccaatgatcagacgctggaggaggtgcttgtggccatcctcaggcaccccaccctggagggctggttcctggccctggagcagcaggccctcccgccgcacacgctcagccctgtcctcgtgaagctcctggccacccactttagtgcaggggtccttcagctgctggcagcaagtgccccgatcctccagaacattgggcagctgggccttctggccaggtactcagaggccatcacccagagtgtgctgaaggaacttcagaacaggagggcgggcccggccacatcaccaccaaagaccccgccgcagctggaggccctgcaggagctgcatccatacatggagggtgcccagctccgtgaggtcaccctggccttgctgagcctgcctgagacacacctggtgacccagcaacccacgaaatcccccgggaaggaaagacacctgaatgctcttggaaagaccctggtgcagctgctgacctgcagcccccaggatcagctgcagagtggtgagctcctgtggtcctccgagtatgtgagaggcctgggggctctgctgcccacgctagcagtggacgagctggacacagtgctcctccacactctgcagagagaccctgtgctggcccccgcagtcggggctgatctgcttgactactgcctggcccggcgcacacaggcggccctcagcatcgctgccctgctcctccaggagagctgcacccacttgctgtggttcgagcagtggtgcctgcaggctggcccagggctcggcctccagggggacctggacgacttccttcccctcatccatgtgtacctccagtgcaggacacggagccacttcacacgcccagcaggagtgtcttccgctgtcattcctgtcttgaggaagaccctgtggaggcagctacagagcaggcttcttagcactgacagtcccccagcatctgggctgtaccaggagatcctggcacagctggtcccgtttgcacgagccaaggatctcagtgtactcatggaccgcctgcccagcttgcttcacaccccaagcagtcacaagaggtggatcgtggccgactccatttcagcagctctggaagggtcagcagaagagctgtgtgcctggagaaggacccttttggagtcctgtgtgaagtggctgatcgtgtctttcagtggtggacagcaagatgatgataatactcagaatcaggagaaggaaatgctgcttagattaaatgcgttgttgcatgcacttaatgaagttgatcctggtgactggcagaaattcgtgaagaagggactcaaatttcggtaccaggaccacacatttttaaagatgctcctcaccgccgtacagctcctgtacagcccagaaagctccgtgcgcacgaagctcatccagctcccggtggtctacgtgatgctcatgcagcactcgctgtttctgccgactctactgacgtctgacggagaggagagcccggacagccaagtaaaagaagcgctggtggacctgatgctgacggtggtggagatgtgcccctctgtctgtgagagcagccactttgcagtgcttctcggggcctatggcgccactctcagcgtcctagatcagaagattttacttctgcttcgagcgtatgagcagaacaagctcagcctcatcaacttcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccaggtaactgcagtcttctcttgggtcagggcttgctatgcatgacttctcagaggtcaggttgattatggtaattattgccataattaccacatgaggacctgaatcttggaaataattcttaaaggatcttcagccatcctcatctgttcattccagtgattttcagcaaagtcacagttagtattttgaacatacagtgattta

SEQ ID NO: 303481 - DNA, 4660 bp, Homo sapiens
cgcgcccgcaaagaagagctcacgggcgtgcggttcaaggctcagctgaaggacccgcagggccccgggccaggcttggaagcgtttgtgtctgctgccaagaagctaccacgagaagatgtgtatgatgttgtggaagggtatataaagatttctgttgagtgtgtcgaaattttccagctcctaagtggagagaaacgacctgaaagtgaaacgatgttaatatttcaagttttcgaggccatattattgcggacagcaagtgatctttcacatttccatgttgtgggaaccaacattgtgaaaaagctgatgaacaaccacatgaagctcatctgtgagtccctgtatgcctcaggttacaggttggctcgcgcctgcctgagcctgatgaccgccatggtgacccagggtccggaagctgccagggacgtctgcagccattttgatttgaataaaaagaccctgtacaccctggtgaccaagagggattcaaagggagtgtacgacgttcggcaggcctacgttcagtttgctctctcctttttaattgcgggtgatgacagcactatagtgcaggtgttggaagtgaaagaatttattccttgcatttttagctcagggataaaggaagataggatctctaccatcaatattttattatccacactgaaaacaaaggtagttcacaataaaaatatcacaaaaacccagaaggtgcgtttctttacggggcagttattgaaccacatagcatcgctgtacaactggaatgggattaccgatgtgaacccagaaaatgtcaaggtttctgccgaagaagcagggaaaaccatggtgcgggagcttgttcataacttcctgatggatctttgctgttcactcaagcatggaattaatttttacgatgcatctttgggtacctttggcagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaagatctatgaggctcagccggagatttcccgggcatttcagaccagagagtttatacccttgcctcggctcctggcaatggtgatggtgaccaccgtgcccctggtgtgcaataagagcatgttcacccaagcattaaacttggacagcacctcagtgaggcacacagccttatcccttatttctgtcattttgaagagggcattaaaaactgttgaccactgcctgaataaagaggtgtggcaggaatcaggcgtgtacacagctgtgatgatggaagaattcgtgcagctcttcagagaagccctgagcaagattttgccagacctgaacactgtcgtgtgggtctggcagtcacttaaaaagcaagagaccaaacaggatgacaagaaagggcagaaaaggagcgatgggcccccggctgcctgcgatgctcaccagtgcgatgatgcagaaaccattcttttgaaagctgttttgctccaggtcatatgcctctaccagaaggtggtcccccacgtggtcatgcagtacaactttgacttcagcaagctcctgaaaggtgtcatctctgagcagggccttcgagaggaggtgcctcccattctgcagcaccacatgctgaaggtggccctggagctgccggccagcaagtttctgtggttaaaggcacaggaaggcccagatgcagaaattattggaggtgaacgatcagtattttacttactaatgaaaatgtttgtgaccagtagccatttacaactgaagtcattgaccaaacttctgatcatgaagattctgcgggacacgggggtgtttgagcacacctggaaggagctggagctctggctggagcatttagagaacaccatggaagaggacaaagagactgtgattcagtttctggaacgcattttattgacattggtggcgaatccctattcatacacagacaaagcatctgactttgtccaagaagcaagcatgctgcaggccactatgacgaagcaagaagccgatgacatgagcattcccatctcccacattgacgatgttctcgacatggtggatgtcctggtggagggcagtgaaggcttggatgaggaaatagggttcacgttgagtgaagacatgatcctgctcacgttcccattcagtgcggtagtccctgcggccctggaagccaggaataagttgctccttgggacaggcaatgaagcagcggaaaacgttgtgacatatctgacggcagtgctgactgacctcctccacacccagagggaccccctggctctgtgtctcctgctccaggcatatgataagcttgagcctccatgcctggtgccttgctgccagcagctctcacggtttaacagatactacagcctctggatcccggagcaagcccgagaggcctggctgctgcaggcacagggcagcccctcgccccctgcccttcccttggcctcgtccttcacagccctgctgcaggcagcctacgagagccaagcgcttcgggacgagcacatccaggtgcagctgcaggccaccatgccacacctgtccatgcagcaggtcctgctcgcggccaagcaggtgttgctctacctgcggagcactgtggagaacttcggccagctgggcagaagtgtgggcccgcccctcctgcagctcttcctggatctcctcaggcgcctggttgtccactgtgagcagctggatgcccagaaccagcagagatgcgaggccgcccgggccgaagccgacctcttcctggacatggagtccgtggcctcgctggagttggccaatgatcagacgctggaggaggtgcttgtggccatcctcaggcaccccaccctggagggctggttcctggccctggagcagcaggccctcccgccgcacacgctcagccctgtcctcgtgaagctcctggccacccactttagtgcaggggtccttcagctgctggcagcaagtgccccgatcctccagaacattgggcagctgggccttctggccaggtactcagaggccatcacccagagtgtgctgaaggaacttcagaacaggagggcgggcccggccacatcaccaccaaagaccccgccgcagctggaggccctgcaggagctgcatccatacatggagggtgcccagctccgtgaggtcaccctggccttgctgagcctgcctgagacacacctggtgacccagcaacccacgaaatcccccgggaaggaaagacacctgaatgctcttggaaagaccctggtgcagctgctgacctgcagcccccaggatcagctgcagagtggtgagctcctgtggtcctccgagtatgtgagaggcctgggggctctgctgcccacgctagcagtggacgagctggacacagtgctcctccacactctgcagagagaccctgtgctggcccccgcagtcggggctgatctgcttgactactgcctggcccggcgcacacaggcggccctcagcatcgctgccctgctcctccaggagagctgcacccacttgctgtggttcgagcagtggtgcctgcaggctggcccagggctcggcctccagggggacctggacgacttccttcccctcatccatgtgtacctccagtgcaggacacggagccacttcacacgcccagcaggagtgtcttccgctgtcattcctgtcttgaggaagaccctgtggaggcagctacagagcaggcttcttagcactgacagtcccccagcatctgggctgtaccaggagatcctggcacagctggtcccgtttgcacgagccaaggatctcagtgtactcatggaccgcctgcccagcttgcttcacaccccaagcagtcacaagaggtggatcgtggccgactccatttcagcagctctggaagggtcagcagaagagctgtgtgcctggagaaggacccttttggagtcctgtgtgaagtggctgatcgtgtctttcagtggtggacagcaagatgatgataatactcagaatcaggagaaggaaatgctgcttagattaaatgcgttgttgcatgcacttaatgaagttgatcctggtgactggcagaaattcgtgaagaagggactcaaatttcggtaccaggaccacacatttttaaagatgctcctcaccgccgtacagctcctgtacagcccagaaagctccgtgcgcacgaagctcatccagctcccggtggtctacgtgatgctcatgcagcactcgctgtttctgccgactctactgacgtctgacggagaggagagcccggacagccaagtaaaaggtgacccctcaccccagcccttccattccgtatccagattttatctcctgatttccttacactggctgcactgaggctcatctccctccggctctcggagctaaggaagcattgccaagacagtgtcagaatgttttatttctgtcaaatccagggtgaagaaatgtctcctctgacttgtggtcaaacagcaaatacaaacctgttttcaaggcctta

SEQ ID NO: 303482 - DNA, 2594 bp, Homo sapiens
cgcgcccgcaaagaagagctcacgggcgtgcggttcaaggctcagctgaaggacccgcagggccccgggccaggcttggaagcgtttgtgtctgctgccaagaagctaccacgagaagatgtgtatgatgttgtggaagggtatataaagatttctgttgagtgtgtcgaaattttccagctcctaagtggagagaaacgacctgaaagtgaaacgatgttaatatttcaagttttcgaggccatattattgcggacagcaagtgatctttcacatttccatgttgtgggaaccaacattgtgaaaaagctgatgaacaaccacatgaagctcatctgtgagtccctgtatgcctcaggttacaggttggctcgcgcctgcctgagcctgatgaccgccatggtgacccagggtccggaagctgccagggacgtctgcagccattttgatttgaataaaaagaccctgtacaccctggtgaccaagagggattcaaagggagtgtacgacgttcggcaggcctacgttcagtttgctctctcctttttaattgcgggtgatgacagcactatagtgcaggtgttggaagtgaaagaatttattccttgcatttttagctcagggataaaggaagataggatctctaccatcaatattttattatccacactgaaaacaaaggtagttcacaataaaaatatcacaaaaacccagaaggtgcgtttctttacggggcagttattgaaccacatagcatcgctgtacaactggaatgggattaccgatgtgaacccagaaaatgtcaaggtttctgccgaagaagcagggaaaaccatggtgcgggagcttgttcataacttcctgatggatctttgctgttcactcaagcatggaattaatttttacgatgcatctttgggtacctttggcagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaagatctatgaggctcagccggagatttcccgggcatttcagaccagagagtttatacccttgcctcggctcctggcaatggtgatggtgaccaccgtgcccctggtgtgcaataagagcatgttcacccaagcattaaacttggacagcacctcagtgaggcacacagccttatcccttatttctgtcattttgaagagggcattaaaaactgttgaccactgcctgaataaagaggtgtggcaggaatcaggcgtgtacacagctgtgatgatggaagaattcgtgcagctcttcagagaagccctgagcaagattttgccagacctgaacactgtcgtgtgggtctggcagtcacttaaaaagcaagagaccaaacaggatgacaagaaagggcagaaaaggagcgatgggcccccggctgcctgcgatgctcaccagtgcgatgatgcagaaaccattcttttgaaagctgttttgctccaggtcatatgcctctaccagaaggtggtcccccacgtggtcatgcagtacaactttgacttcagcaagctcctgaaaggtgtcatctctgagcagggccttcgagaggaggtgcctcccattctgcagcaccacatgctgaaggtggccctggagctgccggccagcaagtttctgtggttaaaggcacaggaaggcccagatgcagaaattattggaggtgaacgatcagtattttacttactaatgaaaatgtttgtgaccagtagccatttacaactgaagtcattgaccaaacttctgatcatgaagattctgcgggacacgggggtgtttgagcacacctggaaggagctggagctctggctggagcatttagagaacaccatggaagaggacaaagagactgtgattcagtttctggaacgcattttattgacattggtggcgaatccctattcatacacagacaaagcatctgactttgtccaagaagcaagcatgctgcaggccactatgacgaagcaagaagccgatgacatgagcattcccatctcccacattgacgatgttctcgacatggtggatgtcctggtggagggcagtgaaggcttggatgaggaaatagggttcacgttgagtgaagacatgatcctgctcacgttcccattcagtgcggtagtccctgcggccctggaagccaggaataagttgctccttgggacaggcaatgaagcagcggaaaacgttgtgacatatctgacggcatgtcacacattgagggaggtctaagaaaaggaaactgccacccatgtttgactgcagctggggagcttcttccacgtctcatagccagcttctccagagggaactcccagagctgactgtactctcctacctcagcctcttcttcctgggatggcgtcaaaatatgaacagatacagcttcatgctttcaggaaaccaccttctcttccatcttctcc

SEQ ID NO: 303483 - DNA, 126 bp, Homo sapiens
cattcccatctcccacattgacggtatgttccattctgttctgcgctgctcagaggtctgaagaccaagccacagtgacgtgttaagagattgagaacaagaactgcactaatgccctaggccaag

SEQ ID NO: 303484 - DNA, 476 bp, Homo sapiens
gctggggcctgccatgactgactgactgcctgtgttctcagaggagcacatgtacctgaaggtcagcaacttcctgctgtcgcatgagtacttgaacatggacaaagtgccaggcttctaccagttcttctacagctccgactttgaggtatgcttccagagtcctcacggctttctgcaggcccctgaattgatgatgcagccaccgttgtcattctgacatttccccatggatcctgtatgctgcacggccaacacgattgtgcagtcggtggccacgcaggcctgcacttcggaatgtctccgtgctgttggctcacttctacatggcgcctcaaaccttaaaaactctgcttcagagtcctgagttttacgacattctcatattttcttggtgaatcactgggttaaatattaaattctgtttttagatattcatattaaatattcttttatagaatacttatctgacttca

SEQ ID NO: 303485 - DNA, 374 bp, Homo sapiens
ggcataataggtgttaaaaaaaaaataaatgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaatatcc

SEQ ID NO: 303486 - DNA, 407 bp, Homo sapiens
tgtttgttctcatttagggtcatgggttttcaggcttgagtggggcctttgccagggaactgccttcttctacccagtatttccctgtctcctgtctgtatcagtaatataggaattagaaaacacaaatatctttttttgtaaactaggttgtagatctgtttgtagttaagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaatatcc

SEQ ID NO: 303487 - DNA, 487 bp, Homo sapiens
tcataatcaaagttttactcaaactttttaaggttttgccaaggaaggggtacaggaaaatcagtcagatacttttggaagattagagaaatcagaaagggtggggaatgaaagagcctagtaaagaagtcacagtctgcaatgaaagcagagaattctgatgaagaatagatctgacttctttcatttaggacccaacttaccatatctgatttatttctaggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaatatcc

SEQ ID NO: 303488 - DNA, 683 bp, Homo sapiens
  misc_feature (378)..(378): n is a, c, g, or t
  misc_feature (380)..(380): n is a, c, g, or t
ggacaaattaggcctatggaagggtaaacatcgcatctaactatctcagtggccgtggcgccatgatagagtctatcgtggtaccgctggagctaactccctgggacagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaatatccaaaaaaaaaaaagaaaaaaaaaaaaaagaaaangnggggggggcgcgccgcacgaaagaatatcccccgccgcgaggggcgccccaaagacgacgagcagccacccgcaggtttgggacgaacaaggggggccccaaaaagagggaggctgcgtacatatcataccgagaaggggccccgcggcgcccggcgcggatataaaacaacagcgccagagagtgaggggggacaacacagcgcggcgaagccgcgggagacaccctgggggcgaaggaaacacccaccaatacaggggggggggggggggcacacatcggggggggaacacaacaagccca

SEQ ID NO: 303489 - DNA, 1035 bp, Homo sapiens
  misc_feature (25)..(25): n is a, c, g, or t
attcgcggccgcgtcgacttttttnaggtgttattattattttaatttccagatgaatacacagaagcacagcaaaagtggctccaacaagcaccctctagctccagaatacacgctttagggaactgagtcctctctctctcttgctttctctttccctctcatctgccactccatcagctactttaggttttgtgaatgagtgagggaaaaatagagaaaagagaaagaagaataagaaaggaagagtggaggaaaggaaaaaagaatggagaggttttaccctacttggaataaaattctttctagtagctatccatacctgctcatctatccagaactacagagtagaagggatctttgagttcatcttacaggtgagaaaacaggcttgagaagggaatgactttcccacaaccacagagggagttagggatcaaactaaccactagaactattttcctgacagaatctttgccttgcatgtttcaggcccacctggctcctttcacctttcttacacaggtgacattcccagaacctggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaatatcc

SEQ ID NO: 303490 - DNA, 1437 bp, Homo sapiens
  misc_feature (25)..(25): n is a, c, g, or t
  misc_feature (1055)..(1055): n is a, c, g, or t
  misc_feature (1063)..(1063): n is a, c, g, or t
  misc_feature (1132)..(1132): n is a, c, g, or t
  misc_feature (1134)..(1134): n is a, c, g, or t
attcgcggccgcgtcgacttttttnaggtgttattattattttaatttccagatgaatacacagaagcacagcaaaagtggctccaacaagcaccctctagctccagaatacacgctttagggaactgagtcctctctctctcttgctttctctttccctctcatctgccactccatcagctactttaggttttgtgaatgagtgagggaaaaatagagaaaagagaaagaagaataagaaaggaagagtggaggaaaggaaaaaagaatggagaggttttaccctacttggaataaaattctttctagtagctatccatacctgctcatctatccagaactacagagtagaagggatctttgagttcatcttacaggtgagaaaacaggcttgagaagggaatgactttcccacaaccacagagggagttagggatcaaactaaccactagaactattttcctgacagaatctttgccttgcatgtttcaggcccacctggctcctttcacctttcttacacaggtgacattcccagaacctggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaatatccaaaaaaaaaaaaaaaaaaanacaaaaanaaaaaaaaaaaaaaaaaaaaaaaaaaaaaaaacaaaaaaaaaaaaaaagaaaaaaaaaaaaaagaaaangnggggggggcgcgccgcacgaaagaatatcccccgccgcgaggggcgccccaaagacgacgagcagccacccgcaggtttgggacgaacaaggggggccccaaaaagagggaggctgcgtacatatcataccgagaaggggccccgcggcgcccggcgcggatataaaacaacagcgccagagagtgaggggggacaacacagcgcggcgaagccgcgggagacaccctgggggcgaaggaaacacccaccaatacaggggggggggggggggcacacatcggggggggaacacaacaagccca

SEQ ID NO: 303491 - DNA, 1401 bp, Homo sapiens
  misc_feature (25)..(25): n is a, c, g, or t
  misc_feature (1096)..(1096): n is a, c, g, or t
  misc_feature (1098)..(1098): n is a, c, g, or t
attcgcggccgcgtcgacttttttnaggtgttattattattttaatttccagatgaatacacagaagcacagcaaaagtggctccaacaagcaccctctagctccagaatacacgctttagggaactgagtcctctctctctcttgctttctctttccctctcatctgccactccatcagctactttaggttttgtgaatgagtgagggaaaaatagagaaaagagaaagaagaataagaaaggaagagtggaggaaaggaaaaaagaatggagaggttttaccctacttggaataaaattctttctagtagctatccatacctgctcatctatccagaactacagagtagaagggatctttgagttcatcttacaggtgagaaaacaggcttgagaagggaatgactttcccacaaccacagagggagttagggatcaaactaaccactagaactattttcctgacagaatctttgccttgcatgtttcaggcccacctggctcctttcacctttcttacacaggtgacattcccagaacctggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaatatccaaaaaaaaaaaaaaaaaaaaaaaacaaaaaaaaaaaaaaagaaaaaaaaaaaaaagaaaangnggggggggcgcgccgcacgaaagaatatcccccgccgcgaggggcgccccaaagacgacgagcagccacccgcaggtttgggacgaacaaggggggccccaaaaagagggaggctgcgtacatatcataccgagaaggggccccgcggcgcccggcgcggatataaaacaacagcgccagagagtgaggggggacaacacagcgcggcgaagccgcgggagacaccctgggggcgaaggaaacacccaccaatacaggggggggggggggggcacacatcggggggggaacacaacaagccca

SEQ ID NO: 303492 - DNA, 1383 bp, Homo sapiens
  misc_feature (25)..(25): n is a, c, g, or t
attcgcggccgcgtcgacttttttnaggtgttattattattttaatttccagatgaatacacagaagcacagcaaaagtggctccaacaagcaccctctagctccagaatacacgctttagggaactgagtcctctctctctcttgctttctctttccctctcatctgccactccatcagctactttaggttttgtgaatgagtgagggaaaaatagagaaaagagaaagaagaataagaaaggaagagtggaggaaaggaaaaaagaatggagaggttttaccctacttggaataaaattctttctagtagctatccatacctgctcatctatccagaactacagagtagaagggatctttgagttcatcttacaggtgagaaaacaggcttgagaagggaatgactttcccacaaccacagagggagttagggatcaaactaaccactagaactattttcctgacagaatctttgccttgcatgtttcaggcccacctggctcctttcacctttcttacacaggtgacattcccagaacctggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaatatccaaaaaaaaaaaagaaaaaaaaaaaaaagggggggccgcccaaaatttccccccgggggcgcccagtttgggttccccaggttttcttgggacaaggggggccccataatagggggggagcgcgcgatattaaaataacgccataggcacagcgggcccgcccgtgttacaccaaccgtccgctgaagcggggaaaacagcggccacgccgtgggggacctcttgggggaagggacccctaacttgcgggggggggcacactatggggggacaacacataccatagcagagaatttaaaagccccaagggcacatctataacacttctacaagggggctacacaggcgc

SEQ ID NO: 303493 - DNA, 1419 bp, Homo sapiens
ctgcagaatgttggccccaatcctgtggtccagatcatttacagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaaaaacaaa

SEQ ID NO: 303494 - DNA, 1592 bp, Homo sapiens
ctgcagaatgttggccccaatcctgtggtccagatcatttacagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaaaaacaaaaagggggggggttaaaatatcttgagggcaagtttagcgtacaggtttggaaaaggggccaaggggggataaaagaagaaggggggttaaagtggatggaaacgtatggatttggagactttgggggaatggaactagattagcggaaaaaggaagaagatatgggaagagaa

SEQ ID NO: 303495 - DNA, 1313 bp, Homo sapiens
ctgcagaatgttggccccaatcctgtggtccagatcatttacagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctattcagtaagcagggaatacagtcgttccatcagagctggtctgcacactcacattatcttgctatcactgtaaccaactaatgccaaaagaacggttttgtaataaaattatagctgtatctaaaaacaaaaacaaa

SEQ ID NO: 303496 - DNA, 1549 bp, Homo sapiens
ctgcagaatgttggccccaatcctgtggtccagatcatttacagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaaaaacaaaaagggggggggttaaaatatcttgagggcaagtttagcgtacaggtttggaaaaggggccaaggggggataaaagaagaaggggggttaaagtggatggaaacgtatggatttggagactttgggggaatggaactagattagcggaaaaaggaagaagatatgggaagagaa

SEQ ID NO: 303497 - DNA, 977 bp, Homo sapiens
gcttaggatttattttccttttaagatgggtaaaagaagtatttaaaatgtgaagagtagctgtaggtatctagaatttacagtttgttaaattttttttaactctatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaaaaacaaa

SEQ ID NO: 303498 - DNA, 889 bp, Homo sapiens
gggtttattttctcttgatctttctactgctttgttcttccttcacaaaatcaagtctttgttttttgttgttgtttacaggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaaaaacaaa

SEQ ID NO: 303499 - DNA, 718 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtaaggctttactacaattgttgttaaaaatgatttagtattacaaaaggacttggcatattccgtaaaataaagtagttttaaaactgtaatcaaaatagtctctctctgggaaaaactgaatataaaattgtctctccaccctttctaccttttatgaagcctgaacttaaacgaagatttagaacaagttgtacaaaaatagaaatacaagttcttttatgatgaattttcattagattttctggccttcaattagtttttgaaatctaaagc

SEQ ID NO: 303500 - DNA, 544 bp, Homo sapiens
gctttaaactatgactggattataacgtttgggaagttggtgcattcatctgtggttattaagaccttacagatcttgtattcaagatgggaaaactagtcctttacatgcctcctgagaagagttaattttgtatacttttatatacttactgtgcctacaacctatataaaaagtagccattgtgtaatgatttttaaaattttctgtaactggtatcttcacataactaaaagtaatcttaaaatatcttttattggggaaaaattggttattttaaggttaatagactcaattcttgttttgtttgctattaacaacctataaaacagtaacataatgagaattattttttaaagttctattgtgtatccctttcaatggttttccccttcatagacgggattctccaaggaaaaatcagattgtttttgacaacaggtcctatgattcattacacaggtatcatcctgctgtgacgttgtgatttgagacttttaaataacatgttcaggatagggctgagctttttctacctggattg

SEQ ID NO: 303501 - DNA, 829 bp, Homo sapiens
tattagataaaaggaaacttatttcatccccttctgaatctcaaaatgtatttacaagttaaaatattcttgggtgaaaatagttatttgcgtttgtgcctaattctctgatactaactgtagtctacatttatacattgtgtctgaatgctggttttgtggcttcactagctccctttttctctctccttttttatcctgtcttttgctgctgctttccaccttctgtccagctccatcttcagacagctccctgtataacgctccacttcctgagtattccagttgccagcctccttcagcacctcctccatcatacgctaaagtcatctcagctccagtgtcagatgccactcctgattatgctgtagtgactgctttgccacctacttccacaccccctacaccaccactgcgacactcagcgacacgttttgcaacatctttaggttcagccttccaccctgttcttccccattacgctacagttcctcgtcctctgaacaaaaactctcgaccttcttctcctgtgaacacaccctcttctcagcctccagctacgaagccctgtgcctggtctacttccaatttttcgcccctccctccatctcctccaataatgattagcagccccccaggcaaagctactggtccaaggcctgtcctccctgtttgtgtttcttctcctgtgccccaaatgcctccatcaccgacagcacccaatgggctggttgctctgtaacatatccagtgtctccaccgcctacctcagggccagcagctcctccgccgccgcctccactgccttccctcgcatcactctcacact

SEQ ID NO: 303502 - DNA, 414 bp, Homo sapiens
ttaaaacaaaattcaccaaggctagtcttccaagaaatagaattgtggctctggaaacaaaaaaaactacacatcatatttcatgacattcttaaaattttatgagtaagaatctctttagtggtaattttgttctgtatttctggtatttttctctaatattttaggacattttagatgaaatgagaaaagaattaacaaagctaaaagaagagctcattgatggtaagtgtctggacaaatttactattcctataaaacaatgtttaagattgaccatttttaagaaaatgcaaataaggaaatacccagctgattagttgagggcaatgacttccatagtcctgcccttttaggattagggtttaggggaggaggtttctccttcatataatggaaattaagcctttgcaa

SEQ ID NO: 303503 - DNA, 446 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgaggtgaggggcgcgcggggcgggggccgggcgggccattgtgccgcgggagccgcgacccccgttctcctcggaccccgccttccctctcccggcccggcgcgtctcccctggtctccggtctgttcctcccccctccgccttttgtcccttccaatttctctttctttctt

SEQ ID NO: 303504 - DNA, 385 bp, Homo sapiens
  misc_feature (365)..(365): n is a, c, g, or t
  misc_feature (367)..(367): n is a, c, g, or t
ccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaaggaattttcttgaaaaggggttcaccattgggaaccngnccaaaagggggccaaggt

SEQ ID NO: 303505 - DNA, 307 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagacagagtctgactgttgcccaggctggagtg

SEQ ID NO: 303506 - DNA, 7568 bp, Homo sapiens
ccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303507 - DNA, 6352 bp, Homo sapiens
ccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggtaacagggagactcatttctacaaaaaaatttaaaaatttaggccaggcatggtggtgcacacctgtaatcccagctactcaggagactgaagcgggaggatcacctgagcccagggaggacgcggctgcagtgagccgttatcatgccactgtactccagcctgggtgacagagcgagaacctgtctcta

SEQ ID NO: 303508 - DNA, 3633 bp, Homo sapiens
ccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatata

SEQ ID NO: 303509 - DNA, 3779 bp, Homo sapiens
ccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaaaacccgggtgttggactctctgtgcttatttttccccattctatctcccaaattggctataagtgtgttctcttcccaaaaagttcggagggatttttttttatccctttggcgcttccaatactgtgaccgggtggtggcccctttttaagagattttccgggtatttaaatggggaaacaaacccctaaggttttttcctttaataaaaacccgtttctcttggaccccctttattatgatgggtctcgggcctctggtaccgtggaatgtctaacgcgagtacagttaagcggacccttcttaaatgacgggaaggccctggttccctccaacctggtgttctgctctgtgacagggtctgtctcttttccctatgtaattgcgtccccagtctctttggcaccaactgggtgtgtcccattctagcggcggggggcgaaatctctttcgaaatgtcctctggattaaacggcggtttcaacattttgccagcttcggtgtcctccaactggggatgaaccgcttgaaggttgacccccgcgttaggggactccctttaaaaatcacggttgcatttaccgagaaattgtcggattgtgcataagagcccacagccaccgtgcggcggaaaaacggttttttacaaaacacacacaccgatgtagacgaatacatacgggtgacgtgagcaacaaggagattagctacaagacagcaagtgtgtctctcattcatattctttattacattgtttgactgcattctgcgatgaaggagggggtt

SEQ ID NO: 303510 - DNA, 3548 bp, Homo sapiens
  misc_feature (3077)..(3077): n is a, c, g, or t
  misc_feature (3082)..(3082): n is a, c, g, or t
  misc_feature (3086)..(3086): n is a, c, g, or t
  misc_feature (3096)..(3097): n is a, c, g, or t
  misc_feature (3107)..(3107): n is a, c, g, or t
  misc_feature (3109)..(3110): n is a, c, g, or t
  misc_feature (3113)..(3113): n is a, c, g, or t
  misc_feature (3131)..(3131): n is a, c, g, or t
  misc_feature (3133)..(3133): n is a, c, g, or t
  misc_feature (3136)..(3136): n is a, c, g, or t
  misc_feature (3148)..(3148): n is a, c, g, or t
  misc_feature (3152)..(3153): n is a, c, g, or t
  misc_feature (3158)..(3158): n is a, c, g, or t
  misc_feature (3163)..(3163): n is a, c, g, or t
  misc_feature (3175)..(3175): n is a, c, g, or t
  misc_feature (3182)..(3182): n is a, c, g, or t
  misc_feature (3187)..(3187): n is a, c, g, or t
  misc_feature (3191)..(3191): n is a, c, g, or t
  misc_feature (3199)..(3199): n is a, c, g, or t
  misc_feature (3202)..(3202): n is a, c, g, or t
  misc_feature (3219)..(3220): n is a, c, g, or t
  misc_feature (3224)..(3224): n is a, c, g, or t
  misc_feature (3230)..(3230): n is a, c, g, or t
  misc_feature (3247)..(3247): n is a, c, g, or t
  misc_feature (3256)..(3256): n is a, c, g, or t
  misc_feature (3258)..(3258): n is a, c, g, or t
  misc_feature (3260)..(3260): n is a, c, g, or t
  misc_feature (3267)..(3267): n is a, c, g, or t
  misc_feature (3272)..(3272): n is a, c, g, or t
  misc_feature (3280)..(3281): n is a, c, g, or t
  misc_feature (3285)..(3285): n is a, c, g, or t
  misc_feature (3290)..(3290): n is a, c, g, or t
  misc_feature (3293)..(3294): n is a, c, g, or t
  misc_feature (3297)..(3297): n is a, c, g, or t
  misc_feature (3301)..(3302): n is a, c, g, or t
  misc_feature (3305)..(3305): n is a, c, g, or t
  misc_feature (3309)..(3310): n is a, c, g, or t
  misc_feature (3324)..(3324): n is a, c, g, or t
  misc_feature (3333)..(3333): n is a, c, g, or t
  misc_feature (3351)..(3351): n is a, c, g, or t
  misc_feature (3357)..(3358): n is a, c, g, or t
  misc_feature (3373)..(3373): n is a, c, g, or t
  misc_feature (3382)..(3382): n is a, c, g, or t
  misc_feature (3385)..(3385): n is a, c, g, or t
  misc_feature (3388)..(3388): n is a, c, g, or t
  misc_feature (3395)..(3395): n is a, c, g, or t
  misc_feature (3407)..(3407): n is a, c, g, or t
  misc_feature (3411)..(3411): n is a, c, g, or t
  misc_feature (3415)..(3416): n is a, c, g, or t
  misc_feature (3431)..(3431): n is a, c, g, or t
  misc_feature (3434)..(3435): n is a, c, g, or t
  misc_feature (3437)..(3437): n is a, c, g, or t
  misc_feature (3441)..(3441): n is a, c, g, or t
  misc_feature (3444)..(3444): n is a, c, g, or t
  misc_feature (3446)..(3446): n is a, c, g, or t
  misc_feature (3454)..(3454): n is a, c, g, or t
  misc_feature (3457)..(3457): n is a, c, g, or t
  misc_feature (3463)..(3465): n is a, c, g, or t
  misc_feature (3467)..(3467): n is a, c, g, or t
  misc_feature (3478)..(3480): n is a, c, g, or t
  misc_feature (3493)..(3493): n is a, c, g, or t
  misc_feature (3496)..(3496): n is a, c, g, or t
  misc_feature (3504)..(3504): n is a, c, g, or t
  misc_feature (3508)..(3508): n is a, c, g, or t
  misc_feature (3512)..(3513): n is a, c, g, or t
  misc_feature (3526)..(3526): n is a, c, g, or t
  misc_feature (3533)..(3533): n is a, c, g, or t
  misc_feature (3536)..(3536): n is a, c, g, or t
  misc_feature (3545)..(3545): n is a, c, g, or t
ccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaaacccagggttgagaactctgtgcctaatatttccccattcatctcccagaattggccttaaatggtgttccctttcccaagaangttcntgantgtgaatttnntattattccntnnggncgtatcattacatgtgancngcntgggtgtcattntttnngaganttccnggtattcaaagnggggaancaganaccntaggtttnttnccctttattcaaaaccnncgtntccttngggacccactttatttnatggagggntntntgggtgnctcgnggtacggnngggnatggnctnnaanggcnngangtanncaggttaagggggnatccctttnccttaattggaccgggangggcanntggtttttcccctcnaacatcggntgnatnctggccnctggtggacagngtcnctgnnatctaatcccatctnatnntnaagnggngnctccacanttntccatnnngncaacacaatcnnngattggtccaatntcntaagggcngggnggcnngaaaatcctcctnccaaaanaangtccttccnatg

SEQ ID NO: 303511 - DNA, 3529 bp, Homo sapiens
  misc_feature (3058)..(3058): n is a, c, g, or t
  misc_feature (3063)..(3063): n is a, c, g, or t
  misc_feature (3067)..(3067): n is a, c, g, or t
  misc_feature (3077)..(3078): n is a, c, g, or t
  misc_feature (3088)..(3088): n is a, c, g, or t
  misc_feature (3090)..(3091): n is a, c, g, or t
  misc_feature (3094)..(3094): n is a, c, g, or t
  misc_feature (3112)..(3112): n is a, c, g, or t
  misc_feature (3114)..(3114): n is a, c, g, or t
  misc_feature (3117)..(3117): n is a, c, g, or t
  misc_feature (3129)..(3129): n is a, c, g, or t
  misc_feature (3133)..(3134): n is a, c, g, or t
  misc_feature (3139)..(3139): n is a, c, g, or t
  misc_feature (3144)..(3144): n is a, c, g, or t
  misc_feature (3156)..(3156): n is a, c, g, or t
  misc_feature (3163)..(3163): n is a, c, g, or t
  misc_feature (3168)..(3168): n is a, c, g, or t
  misc_feature (3172)..(3172): n is a, c, g, or t
  misc_feature (3180)..(3180): n is a, c, g, or t
  misc_feature (3183)..(3183): n is a, c, g, or t
  misc_feature (3200)..(3201): n is a, c, g, or t
  misc_feature (3205)..(3205): n is a, c, g, or t
  misc_feature (3211)..(3211): n is a, c, g, or t
  misc_feature (3228)..(3228): n is a, c, g, or t
  misc_feature (3237)..(3237): n is a, c, g, or t
  misc_feature (3239)..(3239): n is a, c, g, or t
  misc_feature (3241)..(3241): n is a, c, g, or t
  misc_feature (3248)..(3248): n is a, c, g, or t
  misc_feature (3253)..(3253): n is a, c, g, or t
  misc_feature (3261)..(3262): n is a, c, g, or t
  misc_feature (3266)..(3266): n is a, c, g, or t
  misc_feature (3271)..(3271): n is a, c, g, or t
  misc_feature (3274)..(3275): n is a, c, g, or t
  misc_feature (3278)..(3278): n is a, c, g, or t
  misc_feature (3282)..(3283): n is a, c, g, or t
  misc_feature (3286)..(3286): n is a, c, g, or t
  misc_feature (3290)..(3291): n is a, c, g, or t
  misc_feature (3305)..(3305): n is a, c, g, or t
  misc_feature (3314)..(3314): n is a, c, g, or t
  misc_feature (3332)..(3332): n is a, c, g, or t
  misc_feature (3338)..(3339): n is a, c, g, or t
  misc_feature (3354)..(3354): n is a, c, g, or t
  misc_feature (3363)..(3363): n is a, c, g, or t
  misc_feature (3366)..(3366): n is a, c, g, or t
  misc_feature (3369)..(3369): n is a, c, g, or t
  misc_feature (3376)..(3376): n is a, c, g, or t
  misc_feature (3388)..(3388): n is a, c, g, or t
  misc_feature (3392)..(3392): n is a, c, g, or t
  misc_feature (3396)..(3397): n is a, c, g, or t
  misc_feature (3412)..(3412): n is a, c, g, or t
  misc_feature (3415)..(3416): n is a, c, g, or t
  misc_feature (3418)..(3418): n is a, c, g, or t
  misc_feature (3422)..(3422): n is a, c, g, or t
  misc_feature (3425)..(3425): n is a, c, g, or t
  misc_feature (3427)..(3427): n is a, c, g, or t
  misc_feature (3435)..(3435): n is a, c, g, or t
  misc_feature (3438)..(3438): n is a, c, g, or t
  misc_feature (3444)..(3446): n is a, c, g, or t
  misc_feature (3448)..(3448): n is a, c, g, or t
  misc_feature (3459)..(3461): n is a, c, g, or t
  misc_feature (3474)..(3474): n is a, c, g, or t
  misc_feature (3477)..(3477): n is a, c, g, or t
  misc_feature (3485)..(3485): n is a, c, g, or t
  misc_feature (3489)..(3489): n is a, c, g, or t
  misc_feature (3493)..(3494): n is a, c, g, or t
  misc_feature (3507)..(3507): n is a, c, g, or t
  misc_feature (3514)..(3514): n is a, c, g, or t
  misc_feature (3517)..(3517): n is a, c, g, or t
  misc_feature (3526)..(3526): n is a, c, g, or t
ccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaacccggggtggattctggttattttccccataatcccaaatggttaagttgttctttcccaagaangttcntgantgtgaatttnntattattccntnnggncgtatcattacatgtgancngcntgggtgtcattntttnngaganttccnggtattcaaagnggggaancaganaccntaggtttnttnccctttattcaaaaccnncgtntccttngggacccactttatttnatggagggntntntgggtgnctcgnggtacggnngggnatggnctnnaanggcnngangtanncaggttaagggggnatccctttnccttaattggaccgggangggcanntggtttttcccctcnaacatcggntgnatnctggccnctggtggacagngtcnctgnnatctaatcccatctnatnntnaagnggngnctccacanttntccatnnngncaacacaatcnnngattggtccaatntcntaagggcngggnggcnngaaaatcctcctnccaaaanaangtccttccnatg

SEQ ID NO: 303512 - DNA, 3460 bp, Homo sapiens
ccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaatagacataaacaaataagatagaaagaagcccagtgtgaattcagcttttttctccccattgatcccagttgtctgaagaggcttgtccccacatgattgttctcatgcgagtgtttccaagtctatgacgatggggcttgaccatcgctttagcctgtggacacgcttcttgaagagaagttccgagtatcggatacctgggtaacacagatgcccccatgggtctattcccccttattccaagaatacccagttgtcctttgggaacacccgaattgatgtaatgccatcggggtttagggtcaagtccttcctgtgtccccggttgtggactgtccttgaaagccgtgaagtatacgaccattcaggggggaacacccttgtgcaaaatgtatgtcgcggaaaaaggcccgcgtgttgttcccctctacaaaaccgttgtgctttttgacccttgttggaccaagcttttgttcatcatccccag

SEQ ID NO: 303513 - DNA, 7631 bp, Homo sapiens
ccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagacgggattctccaaggaaaaatcagattgtttttgacaacaggtcctatgattcattacacagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303514 - DNA, 7147 bp, Homo sapiens
taaatttgcaattatttatgaactcattaagtattaagaatgttgtttacctgtcctggaaatctcatttatacagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303515 - DNA, 6987 bp, Homo sapiens
ttatcttactttatcattatatttattttcaatacttgttcttttccatccagcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303516 - DNA, 6414 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303517 - DNA, 5749 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303518 - DNA, 6218 bp, Homo sapiens
ttcgtatatatgtaaaaatttcatgcacttttgcctccgaactctcgtgtttaattaaaaaaggaagaaaagtttgaaagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303519 - DNA, 5762 bp, Homo sapiens
tattagaggatccccgttggcccatccaatgagaattggaaattcaaatgaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303520 - DNA, 7515 bp, Homo sapiens
ccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303521 - DNA, 6408 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatagtaaaaaagaaaaattttttttttttacaatattttccttggcgcccggttgttggaaaacccctaaaagggggccggcgtttttttttatttttttttttcaaaaaaaaaaaaggcgggcctttttcttttttaatattggcctctggggtaccccacctttttttaatttaccgtttgtgcccacaaaatttgggcaacaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303522 - DNA, 2929 bp, Homo sapiens
ccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaaccgtcgattcgaggggtcctcttggt

SEQ ID NO: 303523 - DNA, 4435 bp, Homo sapiens
gggagtgtctagaggatccctcaaacgtatagaacacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacatgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcagatacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaaggccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaataaatgactgtcataatgacttaggatgttgtaagaatgtctgccacatttattggttatttctgttgaaatctgaaggaatcgatacatctgaaaattgagaaagggaaataggactgtccccgttacagatactctgtgatgcacacaaccttctaaacggaagtgttagtatcatttaaagcacatagtaggccttgagtatttgcagattaacatgcagaaaaaatcaaagatgaagccccaattaagtgtttgaaccaaagaatcacagtcactgagctgcacccccgttctgtgaagcatgttaaatactcataaagagcagagagcagggcccgtagacgcttctggtgtaggacacaggaattctaggcagagggagaaaattaggggccccagttggtggctgagagtaaaaagaatataccatttgagtagtgctgttctttttcctcagtttttaaagacatataattcctagtagttaggacatctaaatagctcggtaaactggtcagaggcgggaggattgcttgaggccagaagttttgagatcagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303524 - DNA, 1207 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctggtaagaagtttacaaactcttctgtgttcttgtatctgagcttggatgatgtctcttgtgcagtcatgtgttaaaatatttcacatttgagatgtttgggattaagccatacaatttgaaattatgaataaatatgcagcaattactacttt

SEQ ID NO: 303525 - DNA, 1849 bp, Homo sapiens
cttttcttttttggagaacatgaagtgtttctaacaaaactgaatgagctagaaagaattctattttgagacatctgtagttgatgcaaagtatttctgtaatcctcaatgacagtacttacatatttgcatagaattttttttttaatttttgaggaaacctctctggagtctgtatttataggagcatcctgaaagtccctattatgtagctggtgggagcgagagagggacagccacactcgtgctgtgagcagagcacaacttcaggcagagtgaatgccttctgagttctcattggaagctttctgttgctcagcctctggcagatttcagaaccttctacttaagccaggtgtggtggtgcgtgctcctaggcacagcgactcggggggctgaggcagaaggatcacttgagcccaaagttggaggccagcctgggcaacatagcgaggcctgtctccttaaaaaataaataaataaataataaataaataaataaataaaaaccttgtccttgactattgtgctgtctgctgcccctttgtagggatggggttggggtcagaataagcatgtgcatgaatggcggaaagctttggtggtgtttgtttgtttgtttgttttttgagaggtgggggagtcagcagtgaacctttctggttaaagaacaacgtacataatttctattatgagatttagaaggttaaatacttttttttttcaggcctaccaagttgatagaccaaaagtatatagtagaacagcacagtagaaaaaatttaaaagtgaatttcttatggtccaaaaggatggatagtcacagtccataacctttcataatatatgctggaattggaatctcttgtcatcttgctttgctctgaattttagaactagaagtgtgcatgtatgtcaaaagattatgcagagctattttctttgctaacaatgtaaacatttgcaccccatgaatgggactttataatctggaagtgagcctaaggttgcgtatactgaagtcatgttttaaaagttaaggttgacttaaacatatacaaggctgtattttaattgtaactagaaatcatttactatgcatacagaacctcatgtatcttatcatggaatttgtgaattaatgggcccttgccgaacttcaagggtaagggaaactggtaacaacttgttttaaatcaacatactataagctcctgcttgcttgactcaagttgtttgaaaatctgaattaaacaggatctcattgtcaggaaacatcttctaagcttgacatctacgtttaagaagggaacgtggaagagaaggtgagacatgaaactaaaacagctgggagggtaggatcagactgcacctgatttttggaccaaagtttcatataggaataaataaaaaggaggaccacttgtgagccaacctaggaaggacttgccagaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303526 - DNA, 1285 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggcttgcaggcagcctctcagccggccgagactccatcccaacagggcattgtcttgggaccacttgcacctccacctcctccaccactcccaccagggcctgcacaggcttcagtagccctccctcctcccccagggcccctccac

SEQ ID NO: 303527 - DNA, 1084 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggtagctctatattgcccaggctggagtagctcattatcgcccaggccttgagtagctcatatcgcccaggctggagtagctcttaattgcccaggcatggagtagctctata

SEQ ID NO: 303528 - DNA, 1154 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgtgaacagagtatctgtcaggcaagagctgctgtgatggtttatgatgatgccaataagaagtgggtgccagctggtggctc

SEQ ID NO: 303529 - DNA, 1669 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctccatcttcagacagctccctgtataacgctccacttcctgagtattccagttgccagcctccttcagcacctcctccatcatacgctaaagtcatctcagctccagtgtcagatgccactcctgattatgctgtagtgactgctttgccacctacttccacaccccctacaccaccactgcgacactcagcgacacgttttgcaacatctttaggttcagccttccaccctgttcttccccattacgctacagttcctcgtcctctgaacaaaaactctcgaccttcttctcctgtgaacacaccctcttctcagcctccagctacgaagccctgtgcctggtctacttccaatttttcgcccctccctccatctcctccaataatgattagcagccccccaggcaaagctactggtccaaggcctgtcctccctgtttgtgtttcttctcctgtgccccaaatgcctccatcaccgacagcacccaatgggctggttgctctgtaacatatccagtgtctccaccgcctacctcagggccagcagctcctccgccgccgcctccactgccttccctcgcatcactctcacact

SEQ ID NO: 303530 - DNA, 1651 bp, Homo sapiens
gtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctccatcttcagacagctccctgtataacgctccacttcctgagtattccagttgccagcctccttcagcacctcctccatcatacgctaaagtcatctcagctccagtgtcagatgccactcctgattatgctgtagtgactgctttgccacctacttccacaccccctacaccaccactgcgacactcagcgacacgttttgcaacatctttaggttcagccttccaccctgttcttccccattacgctacagttcctcgtcctctgaacaaaaactctcgaccttcttctcctgtgaacacaccctcttctcagcctccagctacgaagccctgtgcctggtctacttccaatttttcgcccctccctccatctcctccaataatgattagcagccccccaggcaaagctactggtccaaggcctgtcctccctgtttgtgtttcttctcctgtgccccaaatgcctccatcaccgacagcacccaatgggctggttgctctgtaacatatccagtgtctccaccgcctacctcagggccagcagctcctccgccgccgcctccactgccttccctcgcatcactctcacact

SEQ ID NO: 303531 - DNA, 573 bp, Homo sapiens
gtttagtcgtggctcatggtaaggggtagtgggagggcaatgtcatagatcaaataataagaaggtaatatcttgggtttagcagtggttctgtctagctggggcggatcctcataagtcaatctgtaagcatgctggcctgtgtgtgggccgtccgtatgacggagttgctcgagcaaagtagcagctcctgctgcaaaatacagtgccttcaaaatgattctctgtgtgaattgcatgcaatttcatgtaaccataaagtgtaacctgtatgtgcatgacatgtgtctagaatgtgtaaagttaggattcagcaggaaggggcctggccctgtcactgtggtggatcagtggacctgctgaagtcactggactcatgtgacttaggtttgcagcatcagacccctgtgtttgcattaagtggccacatcgttgaaatcggatcaatctctccctcagctttctttcctactttgcagctttgctggttttaactgcttcattcttctgcttcttggtatccttttttcttttgaaataaaaacatgaaatacttaattcaaaaaaaaaatg

SEQ ID NO: 303532 - DNA, 1802 bp, Homo sapiens
ccctgagtaggtgaggaggtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgcccaaggaagacagggaaagtcttcagatggcagtaggcccattcctccacatcctagagagcaacctgctgaaagccatggactctgccactgcccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggagcaggtgccgagaggttgccctgatgggctctgcccgctggacatgttcttgaatgccatgtcagtttataccttaagcccagaaaaataccatgcactctgctctcaaactcaggtgatggaagttggaaatgaagagtaactgatttataaaagcaggatgtgttgattttaaaataaagtgcctttatacaa

SEQ ID NO: 303533 - DNA, 905 bp, Homo sapiens
agaaggaaggctggcacataggaaacaaaattaaggatgttcttgttccttctgattatttttctaagggccttctagaattcctggaaattattaccccttcttcttcccagcttgtcagctttgttctttgattccccaaggcctagttggtcacggcttatccaggttaccactctcctgctccctcagcccctcccatctcagttgtgttcacaacaggtctgtgtgctggtgcctgtgttgttgggagtcttcattcacagaggaccccaagaccggactcggtgccatttctctccttctggcccgttgctggcccttatgcattacttgcctttttctcagctctgtctggactcatgaggtcctgggggcagaatcagtctgtgtcccctgaatgctgagtgccctctaggtgcttaaatgttgttcacttttcacagggaaagtcttcagatggcagtaggcccattcctccacatcctagagagcaacctgctgaaagccatggactctgccactgcccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggagcaggtgccgagaggttgccctgatgggctctgcccgctggacatgttcttgaatgccatgtcagtttataccttaagcccagaaaaataccatgcactctgctctcaaactcaggtgatggaagttggaaatgaagagtaactgatttataaaagcaggatgtgttgattttaaaataaagtgcctttatacaa

SEQ ID NO: 303534 - DNA, 902 bp, Homo sapiens
ccctgagtaggtgaggaggtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtgagaggtcggcccgggctggggctggtggggcgaggaccgtgtgccaggccaggagtctcgccctgacacacatcttcagagctttactcgcgcggagcggggctcgggttgggtccagaagaagggaaaacagcagtagccagtgactccccaggctcttgagcaaaggacctgctggggttaggacagccccggaacttccagttttgccctgatgg

SEQ ID NO: 303535 - DNA, 797 bp, Homo sapiens
ccctgagtaggtgaggaggtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtacaagtggaaccccagtataaaggtcccaaccaaattcaggttgattacagttacaatctagctgggatacaaacattctcttacatctcaaaccataacactgtagggcagtg

SEQ ID NO: 303536 - DNA, 435 bp, Homo sapiens
tcggggatgtaactcgactctttcttcccagtcaattcaacactttttgagtgacttttacaagcagagcatagtgcttttattctggaagctcaccgggtagtggggccttcctgtctgtaatatgtatgcacatgtataccacatggatcagagcctctcagatctctgggcttagctggaaatagcagaaggacaggttcctcggcggacctgctgagttatgtttcttctgcaggagcaggtgccgagaggttgccctgatgggctctgcccgctggacatgttcttgaatgccatgtcagtttataccttaagcccagaaaaataccatgcactctgctctcaaactcaggtgatggaagttggaaatgaagagtaactgatttataaaagcaggatgtgttgattttaaaataaagtgcctttatacaa

SEQ ID NO: 303537 - DNA, 2008 bp, Homo sapiens
ccctgagtaggtgaggaggtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgcccaaggaagacagggaaagtcttcagatggcagtaggcccattcctccacatcctagagagcaacctgctgaaagccatggactctgccactgcccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggagcaggtgccgagaggttgccctgatgggctctgcccgctggacatgttcttgaatgccatgtcagtttataccttaagcccagaaaaataccatgcactctgctctcaaactcaggtgatggaagttggaaatgaagagtaactgatttataaaagcaggatgtgttgattttaaaataaagtgcctttatacaaaaaaaaaaaaaaaaaaaaaaaattgtgcgggggccgggcccgaaaaagtttaacacatttgtgggcggggccagggaatagacagggcaagcgtcaagaacccggcaggaaaggggggttccccaaaaaccccgggccgcgcgtgaaccccggtctggtcccggtcaggcgcctccccgggcgcgcccaaacaacaagcacacaga

SEQ ID NO: 303538 - DNA, 1359 bp, Homo sapiens
ccctgagtaggtgaggaggtgggtaggagcttgcttatagaaaagtggaatcgagtagtccttgctggtggagccgctgccgccagggaactcagggccggctcctgttccttcaagactgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgcccaaggaagacagggaaagtcttcagatggcagtaggcccattcctccacatcctagagagcaacctgctgaaagccatggactctgccactgcccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggagcaggtgccgagaggttgccctgatgggctctgcccgctggacatgttcttgaatgccatgtcagtttataccttaagcccagaaaaataccatgcactctgctctcaaactcaggtgatggaagttggaaatgaagagtaactgatttataaaagcaggatgtgttgattttaaaataaagtgcctttatacaa

SEQ ID NO: 303539 - DNA, 1256 bp, Homo sapiens
ccctgagtaggtgaggaggtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtcttgtgagtcacttgaaaggggatgttgcacttaatttaaggtcttgaacatgaggatacctgtcctgactccccaagatggttcccactgtcacccaaggtagtttgggggacaacttgtcatgctgcatacccttatgtcacaggatctggtgaacaggtcgttcctggaggtcgcattcattgcacttcgagtctctcaggggctgacatcccacagaaaagtgaagcattcttcctagttccatagctctccttatgtactcttgaaagacccctggagcgtatgtggaataaaatagagtgtatataattaaa

SEQ ID NO: 303540 - DNA, 964 bp, Homo sapiens
ccctgagtaggtgaggaggtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacatggcctgaattgcacctgccttgagccaccaggacgtctgtactctcacagcgttacaaacat

SEQ ID NO: 303541 - DNA, 2163 bp, Homo sapiens
tgcaacctcagtctcccaggttcaagtgattctcctgccttagcctcccgagtagctgggattataggcacccaccaccacgcccagctaatttttgtattattagtagagacagggtttcaccatgttggccaggctggtctcaaactcaactcctgacctcaggtggtccacccgcctcagcctcccaaagtgctgggattacaggtgtgagccaccgcacctggcctctgtcctcttttagtctagtgtctggttttctagcaaacagtaaatttaaacaagtaaactattatggtttccattgcttacaaaatgattttcctttacattcttatcatgaacactattttaagcatcaaatgcaatcatctaaaatataaaggtcaatcatttataatagaaacaccttgaccacaagcccttgattgaacattttataatatttcatctacttattaaaacaaataatttcccttgggttggaggggaagtgatttcataaattaattagaaagccatctttagcatattgcttatgtctggatccatgtttctgaggaaaaagacattctcaggtgatgtatttttttcatgcattagtatgcatttttaaaaaataatgcatgtttctttaataattaattttcatcttctataagatgccatgtgaagaagttgtggaaatgtagaataaaaagctaaagctgccaaatttctgttgaactcttaaaaacagctcatgtttgtttgtcctctcgggttgtggcctagcctatttgcaatgtaatgaagctgcagggttcttgtatagctaaagcgttcaatgcatttcacgtgctgtggtggatgtgggtgctgtagacaggcttcttctcttcctgctctcaaaatacctcggcttgacatttggacagatcctgtcattgtttaagctgagcaaaaaaccacacaaaagttgtgtaagagatgagataacaaaggagcgagagaaatctcatgtgaatttccaagttttaattcgttctccatgaaggattttcatttcagtgaaagtcgcagcagaagagggaactttctggagtttttgagaatgccaaaccacatttttatcacacttctttggaaatcaatgcctttgcatagaaaatcaaattcagggaccacaaagaattttcagtgggaatgtctagtctgaggggtctgaggttgtttttactttattgtgttgtttaaatattttaaaaatatctttagcgtttggtcttttttttttctgtaaacatttaatttggtctgagaaaagctgaatgtttgggtgtgacgtttgactgaggtggattggggctgcctgtggacattagtgaacaggtggtaggcttcaggaatatccagttttaatcagttgcatttggtacagaattttgagtaatggtgaaaattgttgtctttggaaagcacaaaagaaacctggaaaggcagttcggctcaggtagctacacataacattgtgtatgattttcacttcaaagctgtctggaaggaaatgcagtcagctccagctagtactatttatgtacccagataactaagatattgtttcatggccttgccttagtcagaggcccttttctctgtcctgaacccccaggtatgggtgaaattggaaattactaatctattggaaatcagttcctgacatagtaaagtttgctttcataactgcagcaaaaaaggtcaacttgccaagtcactgctgccatgtgtgtactgtattattttcagaaaaaaatataatagtctgagtccaagttatcttgatttaaaattgatagagaaaagaaactgtcgagcaagttatataacaactaacaacattgcactttctgtatatgaaatcaatatttaaataacttatttttctccattgctgttcttaaaaacattgtaagtagctgtaatataccagtaccaatatgttcttgcaattgcttcagcccaagaaagctgtgtattgttttaaaaattgtaaaaattattgtgatgattcatttagcataaagagaggtggacggaagggttttcctatgtatcaaaacttgtctataattatgtcatctatgtacctagaaaaaagtaaataaatttcttcagttgaatatg

SEQ ID NO: 303542 - DNA, 776 bp, Homo sapiens
  misc_feature (751)..(751): n is a, c, g, or t
cataattgctttctagcaatcagcttttatttgccttaatataagcttttaagcagttatctaactagtgtccacaaccctgtaaccatacttccacatcttcagcttaggcagacatcgaacctctctgggatgtttccagcaaaagtgagcttttctaatcgtctcattgtaacatggcttattttgtagaggtattcatcagccacacacttcatgttggtttttggtttttaagctaactacaaatctagtaaaaagctatctgaaattcacaaatatcatgtgtgtgcgtgcgtgcgtgcgcgtgtgtgtctgtattcatagtgactgcttttggttttaaccagtttagtatcgttactgtgtggatcgtcgcgctgcagtattgacttggaatcctgaccatgtccatcccaaaattcagtcctcagttaacggatcatgtttgcaaaaggtcactgtgaggctgcatatttcagaaagatgtccttaataagggaagtcatgtataagatgttttctaaaagacttttcagtattacaactaatactattattatccttctttttttatttagataattcttttaatttaaacaaaggttcactatggaaccagacaaatctcattagccatgtgttaagtatttgctactttaaattgttttacaactgatttcagcaagaatcacttgaacccgggaggcagaggttgtagtgagcccagattgtgccactgctctccaanctgggaggcacagcaaactgtcccc

SEQ ID NO: 303543 - DNA, 671 bp, Homo sapiens
cgtctcattgtaacatggcttattttgtagaggtattcatcagccacacacttcatgttggtttttggtttttaagctaactacaaatctagtaaaaagctatctgaaattcacaaatatcatgtgtgtgcgtgcgtgcgtgcgcgtgtgtgtctgtattcatagtgactgcttttggttttaaccagtttagtatcgttactgtgtggatcgtcgcgctgcagtattgacttggaatcctgaccatgtccatcccaaaattcagtcctcagttaacggatcatgtttgcaaaaggtcactgtgaggctgcatatttcagaaagatgtccttaataagggaagtcatgtataagatgttttctaaaagacttttcagtattacaactaatactattattatccttctttttttatttagataattcttttaatttaaacaaaggttcactatggaaccagacaaatctcattagccatgtgttaagtatttgctactttaaattgttttacaactgatttcagcacattctatccttttttttttttgaaatggagtttcgctcttgtcacccaggctggagtgcaatggcacgatcttggctcactgcaacctcagtctcccaggttcaagtgattctcctgccttagcctcccgagtagctgggattat

SEQ ID NO: 303544 - DNA, 235 bp, Homo sapiens
gcacgaggttaagagttccagccttccctctgtaccccttgatagttccagccttccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 303545 - DNA, 2813 bp, Homo sapiens
tcctcttcctctctctggacgcccggctcctccgcaccccctcccccgggggtcccgcggccttgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 303546 - DNA, 1732 bp, Homo sapiens
tcctcttcctctctctggacgcccggctcctccgcaccccctcccccgggggtcccgcggccttgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagcccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 303547 - DNA, 3540 bp, Homo sapiens
tcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 303548 - DNA, 2580 bp, Homo sapiens
tcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 303549 - DNA, 3880 bp, Homo sapiens
tcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 303550 - DNA, 3295 bp, Homo sapiens
cacgaggaggcagcctggcctgcacccaggtgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 303551 - DNA, 4290 bp, Homo sapiens
  misc_feature (3913)..(3913): n is a, c, g, or t
tcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaaaaaaaaaaaaaaaaaaaaaaaaaaaaaaaaaanaaaaaaaaaaaaggggggggggggcaaaaaattccccggggggggcccatttagggggaccccgcgttttttgtggaaaaggggggcccccaaaaggggagcgccccctaataaaaacagcacgagagggacgcgcggccgcgcataacaacaccgttggtcgggggggaaaacacgggcccccgcgggacatcggggggaagcgagacccccactcgcgggggcggggccaccatcggggcgaccacaccccccacgagagatataacgccccggaggcaaataatcaacactggaggtgttatgggtgctatcccgagcgcgtatagtcgtggcgtcggaaaaatgcctcaccggggtaatgttgggacatttcg

SEQ ID NO: 303552 - DNA, 1974 bp, Homo sapiens
ggaaaatgcaactgaaggaattgttgtgaaaaaagggacagcgagtttgaaataaaagttgttagagtggtactgaggagaaaaaagaatccgagaccatgtactgcgcatacacaatcccgggcatgggcggcaactctttgatgtactactataatgggaaagcggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303553 - DNA, 1107 bp, Homo sapiens
cttctctttataagcccgcagttcccggatgtgaatggattacaatgtatctttcagggaaacctattattatcaatgtgactccacgggggagtccatggtgatgatgatgaggaggaggatgatgatgatgagacacctctaaacttggaacaagtttaagactttatgagagaagaaaaaaaatcaccaacaagaattgtttgaggaaaaattataactatcctgtgttcatttttttttttataaacaataagaaaaagttgttggatttttttttaatgatttcttttttgggggagggaattttgttgcagttttatggtggaaaatgcaaaaaccagagccaggtgcataatcttgtaatctgtggatatccctggagcaggactgagtaccagttaaaatactttttggggatacacatgtgagatactaagtacttgcagaagatttttgtctctctttttaaagtctctttccttggaatattgtgagaatatttgtggccatttaaggtaacgtttcaatttgccgtcagagtaaactgtttgtaattgaatttaatttttaaaatgtcgatcccgatgttttattaaaacaaaagggacaacctattaaataattgccaatgggaaaaagtgtgtgcatgcattttgtgtatgtactcgcacatctagcaataccaggatttgtagaatgtgtgttttttttttcaaacacagcgttaaaatagcttatgttgcatataccggataaagcacgcttgttattacgaaacgatagaattatgaagcttaaattttatcctaaaaagtgatgtgaaaaagtatgttttaagagcatgcagggcctataatggtaaatgttgaattaaaaacttacagtgctggcgaacagggacttagcgtgcctaggaactcaagtgcaaaaacaaaacaacatccacccccaaaaattgccctttttttttttcgaagtttgcagttatactattctgtgacttaaaagggaggggaaagaaagtatgcaattcagatttcgcccccaacgcaaaactaccgaaacgaaaatctccccaggaaaatgtggcttgatttatagacg

SEQ ID NO: 303554 - DNA, 779 bp, Homo sapiens
gtataattcctaccatattgtcaaatggagtctatatctcctcaaagggaaagaaacactgacgtgagtcagaagttttcactcacttggcactgaatcagcttaaagttcgaggttgaaaaattcacaaatatttatagcacacctactaagtgccacgcctcctggaaggtggacagcaatggccaatgtttctgccattggaaagatttgcaccgaagtgtgtatggccacatgtagttgtacaaatcagagttcattttgtaatgctttataagggtctggtaccactgattctccttgcagactaataaacacagagcttatatgactcttaaaaatacagtgatagcaagtgcatcctaaattatgtaatcatgtggtccatgataacagtgtaatatatgatatacagatggaatcagccacctggcttactgtaattgttgttgaggtcctttgttatgaacatatatttctgttaacaatgcaacaaaataattttttaagctgtttttttttttctgtactgcctcaaatctagataaacggaatgtgttggaaaggacaacaaataagaagttaaatatgtggaaatgacatggaaagcacctgtttcttccctttgttttcttctacgtcatcaggaaataatatttaaccatagaatatggtgtccctctaagaaaatgtttataattgaatgttcaaagtagaatatagattaaataagtaaagatgacttgccaaaaaaaattaaagaacatttgaaacaaaca

SEQ ID NO: 303555 - DNA, 515 bp, Homo sapiens
cttctctttataagcccgcagttcccggatgtgaatggattacaatgtatctttcagggaaacctattattatcaatgtgactccacgggggagtccatggtgatgatgatgaggaggaggatgatgatgatgagacacctctaaacttggaacaagtttaagactttatgagagaagaaaaaaaatcaccaacaagaattgtttgaggaaaaattataactatcctgtgttcatttttttttttataaacaataagaaaaaaaaaaaaaaaaaaaaaaaaaaaaaaaaaaaaaaaaaaaaaaaaaaaaaaaaaaaaaaaaaaaaaaaaaaaaaaaaatagaaaaaaaataaaaacacaaaaaaatttatttttacaattttaaaatcacttacaattattattaccacaaccttaattacaattcttatgattttccctcaactcaattttcatttttctttttaattatctatcttcttcctcctaactttctctatctttccttcttgtccc

SEQ ID NO: 303556 - DNA, 2337 bp, Homo sapiens
acaggcaaatcctatacgagatggaaatggacattgccacgtttatggccaagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303557 - DNA, 2463 bp, Homo sapiens
cggggggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303558 - DNA, 2355 bp, Homo sapiens
tccttgttatctgtaatcatcacaacagtactggagggtaaatacggtcattcccattttacagatgaggatacattcaatgtgagatgttaaagatgttcttcagaatttcccaggtagcaggcagctcatggtattcaaaagatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303559 - DNA, 2196 bp, Homo sapiens
cttactaataggaattggcgtgattcctcacagacacaaagatttcctctgctgagtaagcgtgaggccccttaacttgtgaaagcatcatccagaccgtgtgagtctgtctgtgtatgtgcagaacacagaccctcctttctccgtttgtggggaatacttccctcgggtgaaactgaagttaatttttttttttttccaaacacaagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303560 - DNA, 2110 bp, Homo sapiens
ttgggcttagatcttctggtgcctccctcggcgtgctacccataaggtcgaaagaaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303561 - DNA, 2192 bp, Homo sapiens
atttctgctttctgtgaaatttgagaatagaacagaccatagtgtgtcttccagtgaatcagtttctcttgtgccgtattgttatttgaatccctgtctacaacatcagctatgcaaaccaaagagaaaggcaaaatctcagtatcttgggcttcaagtctaaatagcagatcacagctgaaatgattccccactgtgtgacaagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303562 - DNA, 343 bp, Homo sapiens
gggtcagaagccactatcatcatggtagcccggtgcctggttcttaattaaaggcaacaggagattaatttgaaacattaatttgaaagtgcatatacaaaaagaaaaaattactgcaagaaagcctaaagaacttttctcttgtccctagatgtagaagacagaagtagctcagggtcctgggggaatggaggacatccaagcccgtccagggtaagtatatctaatcttttctcccacaaccagacatcccacatatgtaaattgacaaacagaaggtgtgtttctctctctctctctctctctctctcacacacacacacacacacacacacacacacac

SEQ ID NO: 303563 - DNA, 2555 bp, Homo sapiens
cggggggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303564 - DNA, 2836 bp, Homo sapiens
cttctctttataagcccgcagttcccggatgtgaatggattacaatgtatctttcagggaaacctattattatcaatgtgactccacgggggagtccatggtgatgatgatgaggaggaggatgatgatgatgagacacctctaaacttggaacaagtttaagactttatgagagaagtttttttttataaacaataagaaaaagttgttggatttttttttaatgatttcttttttgggggagggaattttgttgcagttttatggtggaaaatgcaaaaaccagagccaggtgcataatcttgtaatctgtggatatccctggagcaggactgagtaccagttaaaatactttttggggatacacatgtgagatactaagtacttgcagaagatttttgtctctctttttaaagtctctttccttggaatattgtgagaatatttgtggccatttaaggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303565 - DNA, 2802 bp, Homo sapiens
cttctctttataagcccgcagttcccggatgtgaatggattacaatgtatctttcagggaaacctattattatcaatgtgactccacgggggagtccatggtgatgatgatgaggaggaggatgatgatgatgagacacctctaaacttggaacaagtttaagactttatgagagaagaaaaaaaatcaccaacaagaattgtttgaggaaaaattataactatcctgtgttcatttttttttttataaacaataagaaaaagttgttggatttttttttaatgatttcttttttgggggagggaattttgttgcagttttatggtggaaaatgcaaaaaccagagccaggtgcataatcttgtaatctgtggatatccctggagcaggactgagtaccagttaaaatactttttggggatacacatgtgagatactaagtacttgcagaagatttttgtctctctttttaaagtctctttccttggaatattgtgagaatatttgtggccatttaagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303566 - DNA, 2377 bp, Homo sapiens
agcacaggagagtaacaaggaaggccccttaaaagaaaggccttttaaagtggaggtctcagttcacaaactttaaaagtttacgaagtagtattttagaattttaatcaccagatatattgggggaatttattacttcctattcatatggaagaggacagcagagatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303567 - DNA, 1264 bp, Homo sapiens
cttctctttataagcccgcagttcccggatgtgaatggattacaatgtatctttcagggaaacctattattatcaatgtgactccacgggggagtccatggtgatgatgatgaggaggaggatgatgatgatgagacacctctaaacttggaacaagtttaagactttatgagagaagtttttttttataaacaataagaaaaagttgttggatttttttttaatgatttcttttttgggggagggaattttgttgcagttttatggtggaaaatgcaaaaaccagagccaggtgcataatcttgtaatctgtggatatccctggagcaggactgagtaccagttaaaatactttttggggatacacatgtgagatactaagtacttgcagaagatttttgtctctctttttaaagtctctttccttggaatattgtgagaatatttgtggccatttaaggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcaataaacggaatgtgttggaaaggacaacaaataagaagttaaatatgtggaaatgacatggaaagcacctgtttcttccctttgttttcttctacgtcatcaggaaataatatttaaccatagaatatggtgtccctctaagaaaatgtttataattgaatgttcaaagtagaatatagattaaataagtaaagatgacttgccaaaaaaaattaaagaacatttgaaacaaaca

SEQ ID NO: 303568 - DNA, 2190 bp, Homo sapiens
gtaattagttcagtcagtaaaagttgattacaagtaacgataaagttagatttttagtacttaattttaaaatttctttattaaatagtaaatttgttcttaatataaatggtactatctactcttgttttattgcatatcagaataattaaaagaacaatgtgttcaatgcagagtataatcaagcgatttatatattatggcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 303569 - DNA, 1879 bp, Homo sapiens
ggttatctgtgagaaaggggttgtttggaaaggccaaggggtcatgccaatttaaggaaatgccccccatcctccgctgccccatggctctgccctgccccccaccccttcctgaccacggaaacaagatctcctttctggttatatcttccttggggcagagggagtttcagacaagacttctggcaagactgggacccaccttatctggcttcactcaggagccctggctcaaatggaccaaaggactgccctccacggaggaagctactagggtcatcagagtgttggatgatggtcaggctatagcccacacatgcttgagcagcagcagcatctggtgcagctgacccctccctccttgaagcactttctctccctgcttccagcccttctctctgcacctctctggtcaggcctagtcactagcccagcatgtcaactttggcatgacccagggccatggcgttgacatctctatctgcacccacccataggtgctcttgtctagcttaatgactctaaaccccgtctctattctgataatcctcaaatttctgtctgtaacctagacctggccacgaaaccttgggctcctacctcattaccatttctacccaagggtttaaaagacatctcaaattccataggtcctaaatggagtttccaatctttccccctaggcgtgcctctccccagcttctttttttttttttttttggatggagtctagctctgtcacccaggctggagtgccatagtgtgatctcggctcactgcaagcttcgcctcccgggttcacgccattctcctgcctcagcctcccgagtggctgggactacaggtgcccgccaccacggtcggctaattttttttgtatttttagtagagacggggtttcactgtgttagccaggatggtcttggtctcctgacctcgtgatccacccgcctcggcctcccaaagtgctgggattgcaggcgtgagccaccgtgctgggccccccctccccaactttcttcggctctgtcctttgccgctcagaccaaaaaccttagagttgtctttgacttctgtctttcccttccacccacagttaaccaggagaattgcttgaactcagaaggcagaggttgcagtggaaaaaaaaaaaaaagataatttctctctctttctctctctctctgacacttgctttagaggctacattaaaaaaaaaaactagttgccatgctggggaggggtttgggttacacaggtgtatgcacttatgaaacttagtgaagtgtgtgaatttcattgtatgtaaagtttacctcaaaagaaaatattgaacgccagttaaagatacgcctgtaatctgacttctttgggaggccaaggcgggaggatcacttgaggccaggagtttgagactaccctgggcaacacagcaagacctgtctctacaaaaataaataagtaaataaatagccagatgtggtggcacacgatttgcagtcccattactaggggcggggaggggcgctgaggcaggaggtttacttgagcccaggagttcaaggctgtattgtagtgaactaagatcatgccactgcactccagcctgggctacagagctagaccctgtctttaaaaaaaagaaaagaaaaaaaaaagtatgtacactgaaatatttagggaacaataaaccaatgtcgacaatttattttgaaatgcatccagagatgagttggattgatggataaatagtgtaataggtagatgtgagataaagcaaatacagcaaagtgttcatggtaggatctaagtggcggatatgcgggtgtccactgtaaaatttttcaactttgctgtaatttagaaacttttcatggcc

SEQ ID NO: 303570 - DNA, 1934 bp, Homo sapiens
tgggctcatcttcttgggaaaggagaaataattgaaaaactaagcatttaaagttactctaagtacgcaaaataaatttaattgggaggagtaagatgaaagagatagtaagtgggaaatggagactgtggggaaaaaaaatctaattgatgatagggtgatggaattccagaggggctagaattcctcctctgggcataatgaccacctgaacagctgctgaagtctgcagagttctttaactcaagcactgtgcctctattgataacttggtagcatagtaaagtaaacattctctttctttaatcattaggctgttggttcctctggaggatgaacatgttggatgatggtcaggctatagcccacacatgcttgagcagcagcagcatctggtgcagctgacccctccctccttgaagcactttctctccctgcttccagcccttctctctgcacctctctggtcaggcctagtcactagcccagcatgtcaactttggcatgacccagggccatggcgttgacatctctatctgcacccacccataggtgctcttgtctagcttaatgactctaaaccccgtctctattctgataatcctcaaatttctgtctgtaacctagacctggccacgaaaccttgggctcctacctcattaccatttctacccaagggtttaaaagacatctcaaattccataggtcctaaatggagtttccaatctttccccctaggcgtgcctctccccagcttctttttttttttttttttggatggagtctagctctgtcacccaggctggagtgccatagtgtgatctcggctcactgcaagcttcgcctcccgggttcacgccattctcctgcctcagcctcccgagtggctgggactacaggtgcccgccaccacggtcggctaattttttttgtatttttagtagagacggggtttcactgtgttagccaggatggtcttggtctcctgacctcgtgatccacccgcctcggcctcccaaagtgctgggattgcaggcgtgagccaccgtgctgggccccccctccccaactttcttcggctctgtcctttgccgctcagaccaaaaaccttagagttgtctttgacttctgtctttcccttccacccacagttaaccaggagaattgcttgaactcagaaggcagaggttgcagtggaaaaaaaaaaaaaagataatttctctctctttctctctctctctgacacttgctttagaggctacattaaaaaaaaaaactagttgccatgctggggaggggtttgggttacacaggtgtatgcacttatgaaacttagtgaagtgtgtgaatttcattgtatgtaaagtttacctcaaaagaaaatattgaacgccagttaaagatacgcctgtaatctgacttctttgggaggccaaggcgggaggatcacttgaggccaggagtttgagactaccctgggcaacacagcaagacctgtctctacaaaaataaataagtaaataaatagccagatgtggtggcacacgatttgcagtcccattactaggggcggggaggggcgctgaggcaggaggtttacttgagcccaggagttcaaggctgtattgtagtgaactaagatcatgccactgcactccagcctgggctacagagctagaccctgtctttaaaaaaaagaaaagaaaaaaaaaagtatgtacactgaaatatttagggaacaataaaccaatgtcgacaatttattttgaaatgcatccagagatgagttggattgatggataaatagtgtaataggtagatgtgagataaagcaaatacagcaaagtgttcatggtaggatctaagtggcggatatgcgggtgtccactgtaaaatttttcaactttgctgtaatttagaaacttttcatggcc

SEQ ID NO: 303571 - DNA, 1167 bp, Homo sapiens
ggttatctgtgagaaaggggttgtttggaaaggccaaggggtcatgccaatttaaggaaatgccccccatcctccgctgccccatggctctgccctgccccccaccccttcctgaccacggaaacaagatctcctttctggttatatcttccttggggcagagggagtttcagacaagacttctggcaagactgggacccaccttatctggcttcactcaggagccctggctcaaatggaccaaaggactgccctccacggaggaagctactagggtcatcagagtgttggatgatggtcaggctatagcccacacatgcttgagcagcagcagcatctggtgcagctgacccctccctccttgaagcactttctctccctgcttccagcccttctctctgcacctctctggtcaggcctagtcactagcccagcatgtcaactttggcatgacccagggccatggcgttgacatctctatctgcacccacccataggtgctcttgtctagcttaatgactctaaaccccgtctctattctgataatcctcaaatttctgtctgtaacctagacctggccacgaaaccttgggctcctacctcattaccatttctacccaagggtttaaaagacatctcaaattccataggtcctaaatggagtttccaatctttccccctaggcgtgcctctccccagcttctttttttttttttttttggatggagtctagctctgtcacccaggctggagtgccatagtgtgatctcggctcactgcaagcttcgcctcccgggttcacgccattctcctgcctcagcctcccgagtggctgggactacaggtgcccgccaccacggtcggctaattttttttgtatttttagtagagacggggtttcactgtgttagccaggatggtcttggtctcctgacctcgtgatccacccgcctcggcctcccaaagtgctgggattgcaggcgtgagccaccgtgctgggccccccctccccaactttcttcggctctgtcctttgccgctcagaccaaaaaccttagagttgtctttgacttctgtctttcccttccacccacagttaaccaggaaatcctgccatctccgcctttattttattttattttttgagatggagtttcacccttgttg

SEQ ID NO: 303572 - DNA, 1397 bp, Homo sapiens
ggttatctgtgagaaaggggttgtttggaaaggccaaggggtcatgccaatttaaggaaatgccccccatcctccgctgccccatggctctgccctgccccccaccccttcctgaccacggaaacaagatctcctttctggttatatcttccttggggcagagggagtttcagacaagacttctggcaagactgggacccaccttatctggcttcactcaggagccctggctcaaatggaccaaaggactgccctccacggaggaagctactagggtcatcagagtgttggatgatggtcaggctatagcccacacatgcttgagcagcagcagcatctggtgcagctgacccctccctccttgaagcactttctctccctgcttccagcccttctctctgcacctctctggtcaggcctagtcactagcccagcatgtcaactttggcatgacccagggccatggcgttgacatctctatctgcacccacccataggtgctcttgtctagcttaatgactctaaaccccgtctctattctgataatcctcaaatttctgtctgtaacctagacctggccacgaaaccttgggctcctacctcattaccatttctacccaagggtttaaaagacatctcaaattccataggttgcagtggaaaaaaaaaaaaaagataatttctctctctttctctctctctctgacacttgctttagaggctacattaaaaaaaaaaactagttgccatgctggggaggggtttgggttacacaggtgtatgcacttatgaaacttagtgaagtgtgtgaatttcattgtatgtaaagtttacctcaaaagaaaatattgaacgccagttaaagatacgcctgtaatctgacttctttgggaggccaaggcgggaggatcacttgaggccaggagtttgagactaccctgggcaacacagcaagacctgtctctacaaaaataaataagtaaataaatagccagatgtggtggcacacgatttgcagtcccattactaggggcggggaggggcgctgaggcaggaggtttacttgagcccaggagttcaaggctgtattgtagtgaactaagatcatgccactgcactccagcctgggctacagagctagaccctgtctttaaaaaaaagaaaagaaaaaaaaaagtatgtacactgaaatatttagggaacaataaaccaatgtcgacaatttattttgaaatgcatccagagatgagttggattgatggataaatagtgtaataggtagatgtgagataaagcaaatacagcaaagtgttcatggtaggatctaagtggcggatatgcgggtgtccactgtaaaatttttcaactttgctgtaatttagaaacttttcatggcc

SEQ ID NO: 303573 - DNA, 1497 bp, Homo sapiens
ggttatctgtgagaaaggggttgtttggaaaggccaaggggtcatgccaatttaaggaaatgccccccatcctccgctgccccatggctctgccctgccccccaccccttcctgaccacggaaacaagatctcctttctggttatatcttccttggggcagagggagtttcagacaagacttctggcaagactgggacccaccttatctggcttcactcaggagccctggctcaaatggaccaaaggactgccctccacggaggaagctactagggtcatcagagtgttggatgatggtcaggctatagcccacacatgcttgagcagcagcagcatctggtgcagctgacccctccctccttgaagcactttctctccctgcttccagcccttctctctgcacctctctggtcaggcctagtcactagcccagcatgtcaactttggcatgacccagggccatggcgttgacatctctatctgcacccacccataggtgctcttgtctagcttaatgactctaaaccccgtctctattctgataatcctcaaatttctgtctgtaacctagacctggccacgaaaccttgggctcctacctcattaccatttctacccaagggtttaaaagacatctcaaattccataggtcctaaatggagtttccaatctttccccctaggcgtgcctgtaatcccagctactcaggaggctgaggcaagagaattgcttgaactcagaaggcagaggttgcagtggaaaaaaaaaaaaaagataatttctctctctttctctctctctctgacacttgctttagaggctacattaaaaaaaaaaactagttgccatgctggggaggggtttgggttacacaggtgtatgcacttatgaaacttagtgaagtgtgtgaatttcattgtatgtaaagtttacctcaaaagaaaatattgaacgccagttaaagatacgcctgtaatctgacttctttgggaggccaaggcgggaggatcacttgaggccaggagtttgagactaccctgggcaacacagcaagacctgtctctacaaaaataaataagtaaataaatagccagatgtggtggcacacgatttgcagtcccattactaggggcggggaggggcgctgaggcaggaggtttacttgagcccaggagttcaaggctgtattgtagtgaactaagatcatgccactgcactccagcctgggctacagagctagaccctgtctttaaaaaaaagaaaagaaaaaaaaaagtatgtacactgaaatatttagggaacaataaaccaatgtcgacaatttattttgaaatgcatccagagatgagttggattgatggataaatagtgtaataggtagatgtgagataaagcaaatacagcaaagtgttcatggtaggatctaagtggcggatatgcgggtgtccactgtaaaatttttcaactttgctgtaatttagaaacttttcatggcc

SEQ ID NO: 303574 - DNA, 3314 bp, Homo sapiens
attgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcacctaagaataaatggtatttgggcatgtattcccaatatgtgtatatttatttataaatatatacagatactattatctgtatgttagtaataaagcttaaattattccatttta

SEQ ID NO: 303575 - DNA, 3415 bp, Homo sapiens
attgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcacctaagaataaatggtatttgggcatgtattcccaatatgtgtatatttatttataaatatatacagatactattatctgtatgttagtaataaagcttaaattattccattttaaaattatgaatatgaatagggttttttttatgtttcttgcctcatcccaatgacttttgcacacccaggtgtgagcacccagcattcaagaccacgggtta

SEQ ID NO: 303576 - DNA, 3317 bp, Homo sapiens
attgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcaccacgagccggctctttgtgcggctcattgcgtggcgcttggaggaggaagaagacaagaaacgcaaagagccacgcaaagagccgcacgaagggccacgctacgagtccccaaagag

SEQ ID NO: 303577 - DNA, 3607 bp, Homo sapiens
gacacattcatgctagagggatggttataggttgctataataactgacatccctcccattcaccccaccccactcctgagacaccccaggtggtgcccgagattataggacttcaagagaaaggattccctgacctttctcttgccacttttgtggataagatgaaattgtgctctattgtacggaaatggctgatttgggattttctggttctcctcctctcaggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcacctaagaataaatggtatttgggcatgtattcccaatatgtgtatatttatttataaatatatacagatactattatctgtatgttagtaataaagcttaaattattccattttaaaattatgaatatgaatagggttttttttatgtttcttgcctcatcccaatgacttttgcacacccaggtgtgagcacccagcattcaagaccacgggtta

SEQ ID NO: 303578 - DNA, 3429 bp, Homo sapiens
tgctatggttacagggcctggaccttcctccggaaggtgagaaacaggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcacctaagaataaatggtatttgggcatgtattcccaatatgtgtatatttatttataaatatatacagatactattatctgtatgttagtaataaagcttaaattattccattttaaaattatgaatatgaatagggttttttttatgtttcttgcctcatcccaatgacttttgcacacccaggtgtgagcacccagcattcaagaccacgggtta

SEQ ID NO: 303579 - DNA, 2684 bp, Homo sapiens
attgctccaagatggcggcggcggcggcagcgggagcgcagctcagctgggctggaactgccctcctggaactcccccagcctacaacctaggaggtgcagggactgaggctcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggccccatgcggctcacccgctgccaggctgccctggcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcccctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggaacccacttagcaggtgaaagcaatggcagccttccttatttgattatgcacctaagaataaatggtatttgggcatgtattcccaatatgtgtatatttatttataaatatatacagatactattatctgtatgttagtaataaagcttaaattattccattttaaaattatgaatatgaatagggttttttttatgtttcttgcctcatcccaatgacttttgcacacccaggtgtgagcacccagcattcaagaccacgggtta

SEQ ID NO: 303580 - DNA, 293 bp, Homo sapiens
gccaaatcgcaactcagacccagtgaacccaaggcctgaagagaatttggattcatttaccttgttttgtggggactggagagacaagtaaactctcagagtaactgtcccctctgactaccatttctaaggcaagccccctgtttctactcttgcgccccctgctggtttcctgccctgtctgtaagttgcatggcttttgtccgtcttttttttgtttgtttgtttgttttgagacagggtctcacccaggctagagtgaagtggagcaatctcggctcactgcaacctcc

SEQ ID NO: 303581 - DNA, 377 bp, Homo sapiens
cagttgctggtacagtgctgcacctggctgagtgaatggtttcttttggagctgataaagctgccttatgaaatcagctgacagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaa

SEQ ID NO: 303582 - DNA, 1744 bp, Homo sapiens
caaaaagtcgtcgagctttgctatcatgcggcacaccttactgaactgtccaaccacatgtttcatggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303583 - DNA, 1681 bp, Homo sapiens
ggcgtcacagagcgcatgcgtcgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303584 - DNA, 1221 bp, Homo sapiens
ggcgtcacagagcgcatgcgtcgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaa

SEQ ID NO: 303585 - DNA, 1174 bp, Homo sapiens
ggcgtcacagagcgcatgcgtcgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaa

SEQ ID NO: 303586 - DNA, 1931 bp, Homo sapiens
ggcgtcacagagcgcatgcgtcgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaatagcaggttttgctgaactgctgagccttggcagtgggcgcctttgaggcttagaagtgcctcaggattctgtcagtcggctgccatgctatcttcttttgacgcactataacagtcagcagagaagatcctggggagcttctgaaccccgaaggcacctgctaccaccgctcagtgaaacttgcttcagaggcagaaagaagcaggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303587 - DNA, 1639 bp, Homo sapiens
caaaaagtcgtcgagctttgctatcatgcggcacaccttactgaactgtccaaccacatgtttcatggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303588 - DNA, 1607 bp, Homo sapiens
caaaaagtcgtcgagctttgctatcatgcggcacaccttactgaactgtccaaccacatgtttcatggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcacatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303589 - DNA, 1674 bp, Homo sapiens
ggcgtcacagagcgcatgcgtcgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303590 - DNA, 1713 bp, Homo sapiens
ggcgtcacagagcgcatgcgtcgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303591 - DNA, 1592 bp, Homo sapiens
caaaaagtcgtcgagctttgctatcatgcggcacaccttactgaactgtccaaccacatgtttcatggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303592 - DNA, 1340 bp, Homo sapiens
catgaaggagctaaagctcttgatgcaactgatcaaatagaagttctagcgcatatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303593 - DNA, 786 bp, Homo sapiens
catatgttgaaccagccttgcatcccagggatgaagcagatttgatcatggtggataagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303594 - DNA, 758 bp, Homo sapiens
ggcgtcacagagcgcatgcgtcgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttggggggatgcaagacgggatatgctgaccccttatgatgccttcaggtgggaactgaagcccggttgtcccagggccaataactgttaagccgggtgaattgccgtggctgaggggacccagttggccgttacgt

SEQ ID NO: 303595 - DNA, 388 bp, Homo sapiens
cgcatttttattgacttaatagttgtgtctaaactattataaagccaaattgggtagtgtgtaactcctactaatgtatttctctcttttttcctcacaggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatgg

SEQ ID NO: 303596 - DNA, 1728 bp, Homo sapiens
ggcgtcacagagcgcatgcgtcgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303597 - DNA, 1845 bp, Homo sapiens
ggcgtcacagagcgcatgcgtcgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaaaacataaaattttgttaaataaaatttttttgttgtattataggaacaaaatcttaagggggggcccggaccccaatttgcccttatgggaatcggtttccaattcatttgccgtgc

SEQ ID NO: 303598 - DNA, 1366 bp, Homo sapiens
ggcgtcacagagcgcatgcgtcgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaaggtgaaagggtgtggattttaagacattagactacaagagctgtttttggttgtcacctttatgctcctccattataacgtcagaaattcattacattaaaaatgtgaaaaatgttgcatggtctgcccttattttggtttaacatatatatctttgggaaagggagggtgagacttggttggcacaaaggctttttttgtttgtttgtttgttttttttttaagaaaaagaacacagaattacatacacaaaattaggtacagggttttgggcggagctctgcaagtgagtggtccttagctcctgcgagagaagatatccagaagttcccacataccctgtagaagaatacggaaagtatcacaagtattgccttggcttgtcaaatatatggcggaattaactctgtataatactatagcctttgcctgatgtaca

SEQ ID NO: 303599 - DNA, 1639 bp, Homo sapiens
caaaaagtcgtcgagctttgctatcatgcggcacaccttactgaactgtccaaccacatgtttcatggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcagtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303600 - DNA, 1233 bp, Homo sapiens
gattgcattttatggtgaccacttgaaccctggtatagcagtgtcgcgattgattgcacagcgcgtcagatatgtcggtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggcagcatcaaaatgaagcctctgatggggggtgatatacgtgcctttaacagataaagaaaagcagtggtccaggtggaagtgattttatcttctgctctttcttcttccacacatgcaagggatgaattgtaaaagcaacatcagcttgaccagtataaaattacagtggattgctcatctcagtcctcaaagctttttgaaaaccaacaccatcacagcttgttttggactttgttacactgttattttcagcatgaaaatgtgtgtttttttagggtttctgattcttcaaagaggcacagagccaaattggtagaggaaggatgcaaagtataaatttgtgtaatattactttaacatgcccatattttacttggaaatattaaaagaaagggttctgtaaaatggaaaacttagtttgtgaattgattttgaggagtggtttttcttttcttggacgcttaattctgttctgatattaatttatcagattgcttttgtgcattggataacaccaccattcacaagttaagattcttggtatttggatatctgttagatgctactaagaaaatagagatgagctttctttttaaagcttttgatgtggtgtcatagaatagcatgttgtagatacaatcagctgctttgttaccttaaaactaggcatttgtaaatattaaaccttaagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagttaaaagtaaaa

SEQ ID NO: 303601 - DNA, 1723 bp, Homo sapiens
ggcgtcacagagcgcatgcgtcgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaccgctcccactatgcaaaatgtaacccatacatggattctccacaatcaataggtttccaagcaacaatcagtgctccacacatgcatgcatatgcgctagaacttctatttgatcagttgcatgaaggagctaaagctcttgatgtaggatctggaagtggaatccttactgcatgttttgcacgtatggttggatgtactggaaaagtcataggaattgatcacattaaagagctagtagatgactcagtaaataatgtcaggaaggacgatccaacacttctgtcttcagggagagtacagcttgttgtgggggatggaagaatgggatatgctgaagaagccccttatgatgccattcatgtgggagctgcagcccctgttgtaccccaggcgctaatagatcagttaaagcccggaggaagattgatattgcctgttggtcctgcaggcggaaaccaaatgttggagcagtatgacaagctacaagatggccagccatccacacacatgcacagcctcatgcatgcggggttgcatcatcacgtgcactttcacaccagcatcacaagcacacacagccagatggtcccagggcatgcacatgtgtcaacaagcaaacatcacagcattgaacccagttattcaacattaccagctggcatctgcctccactcctcaggatccctcaaagacttattctgcaaaaaaccaaacgacccattcaacaggccattgcatattaggacactttgcttcacaactgcgttatttctccagccatgcaaaccatgctgtcgctacacaaaacagggagatattcatcgacattcgtttcaacacgcagggcccccagacagcccaacgttgcgtcaaccggcaacgggaatgccacacgataatccatctgaggtcgttcactagtccacttcttaaacaattacccccacgtaataacgcacccttggcgaaaaacaacacagacgcaacaaaagcggcgggcacacggaccagacctccaacaagaggcaacgacccatacgaaaggagagacacccaacaggccgtcaacgcgcagagaacccgagagaacaaccgcagacacacaaaaaagggggcccccgcaacaagagagccagaacgaaataacacaaacgccaaccagacaccaggcgcccgacagacctcctcaccaacgaccccaagccagcgccgaccaaccatgcgacaccaccgagggcgcacccaacggcacccgagcaacgcaccaccccacacgagcgacggcgaccaacaactggcccaaacccaaccaccacgacaccagctcagcacgcacccaggatccacaacgcccacagccgaccacacaggacaacacagacagcaagaccgcgccaagacgaccc

SEQ ID NO: 303602 - DNA, 854 bp, Homo sapiens
gtaggcaaataataaaaggcagagacgcagctgcttacatgtcacttgaagctctcacccaaaaacctgtcgccaactattgtttgaaatctcatcatcgcagaggccctccgtttaggcctaacactttctgtcaaaatgaaaatgtctttgagaactgacataaattcaactttcaatagtcattgatgtgtgaaatggatcattcaattcctttcaatatgacaggcttcatcctgggagcaagttttgatggagaagagtaagagagattaataagaatcattattctttacagcccttgacgacagggattgacgaggcccagatagtaaatattttaggctttcggagcctgaagttctctgtcacaagtactcaattctaccattgtaacaaaagcagccatagataatatgtaagtgaatggatgtggctgtgtttcagtaagactttattagactctgagatttgaatgtcatataatttccatgggtcatgaaatatttttcttcttttgcttttttctcaaccgtttgaaaatgtagggccgggtgcagtgcttgcacctgtaatcccaacactttgggatgccaaggcagtaggacaactggaggccaggagtttgagaccagcctgggcaacatagcaagaccctgtttcaacaaaaaaaaattttttttgaaattagcagaatgtagtggccatgccagccacatgcctgccatcccagctcctaggatgaggagaaaggatccttgagctcaggagttcaagcctgcagtgagcttgatggtgccactggactcaatgcctaggtgacagagtgaggcccagtatctcaaaaaaaaaaa

SEQ ID NO: 303603 - DNA, 7697 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
  misc_feature (7638)..(7638): n is a, c, g, or t
  misc_feature (7665)..(7665): n is a, c, g, or t
  misc_feature (7686)..(7686): n is a, c, g, or t
  misc_feature (7696)..(7696): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttggggaaancccgccagccgggggaacccactattncaaaaccgccccccaccgcgngaagccccanc

SEQ ID NO: 303604 - DNA, 5791 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
  misc_feature (5491)..(5491): n is a, c, g, or t
  misc_feature (5493)..(5493): n is a, c, g, or t
  misc_feature (5495)..(5495): n is a, c, g, or t
  misc_feature (5497)..(5498): n is a, c, g, or t
  misc_feature (5510)..(5511): n is a, c, g, or t
  misc_feature (5515)..(5515): n is a, c, g, or t
  misc_feature (5523)..(5523): n is a, c, g, or t
  misc_feature (5528)..(5530): n is a, c, g, or t
  misc_feature (5532)..(5532): n is a, c, g, or t
  misc_feature (5539)..(5539): n is a, c, g, or t
  misc_feature (5551)..(5551): n is a, c, g, or t
  misc_feature (5553)..(5553): n is a, c, g, or t
  misc_feature (5557)..(5557): n is a, c, g, or t
  misc_feature (5565)..(5565): n is a, c, g, or t
  misc_feature (5572)..(5572): n is a, c, g, or t
  misc_feature (5582)..(5583): n is a, c, g, or t
  misc_feature (5587)..(5587): n is a, c, g, or t
  misc_feature (5590)..(5590): n is a, c, g, or t
  misc_feature (5593)..(5594): n is a, c, g, or t
  misc_feature (5608)..(5608): n is a, c, g, or t
  misc_feature (5615)..(5615): n is a, c, g, or t
  misc_feature (5627)..(5627): n is a, c, g, or t
  misc_feature (5633)..(5634): n is a, c, g, or t
  misc_feature (5639)..(5639): n is a, c, g, or t
  misc_feature (5649)..(5649): n is a, c, g, or t
  misc_feature (5662)..(5662): n is a, c, g, or t
  misc_feature (5687)..(5687): n is a, c, g, or t
  misc_feature (5690)..(5691): n is a, c, g, or t
  misc_feature (5695)..(5695): n is a, c, g, or t
  misc_feature (5702)..(5702): n is a, c, g, or t
  misc_feature (5705)..(5705): n is a, c, g, or t
  misc_feature (5707)..(5707): n is a, c, g, or t
  misc_feature (5710)..(5710): n is a, c, g, or t
  misc_feature (5712)..(5712): n is a, c, g, or t
  misc_feature (5732)..(5732): n is a, c, g, or t
  misc_feature (5735)..(5735): n is a, c, g, or t
  misc_feature (5740)..(5740): n is a, c, g, or t
  misc_feature (5767)..(5768): n is a, c, g, or t
  misc_feature (5774)..(5774): n is a, c, g, or t
  misc_feature (5778)..(5779): n is a, c, g, or t
  misc_feature (5783)..(5784): n is a, c, g, or t
  misc_feature (5788)..(5789): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaaaacacatgtactacaatgtgtgtattcatagcggcactatttcatagttgacaaattctggaagcaacccaaattctcattcatagtagaatggataaatgtaaatatccacccacacaatgcactactcaacagtatagatgagtatcattaacataatggtgcttgaaagaaaccagatgtaaaataatacatatgactctgtcatataatagacaaaacatggcaaaataaatctgttaagccaagctagtgatggccatgttgggagagcttctgggtgagggtctgttaatcttggttacattgggtgtgcaatttgtgaaattcattgtgctgtacgctgacagtagattttatgtatcttatacttttagagttaaanantntnntttttttttttnngacngagtctcnctgtnnncnaggctgnagtgcagtggcncnatcncagctcantgcaacntccgcctccnnggtncangcnnttctcctgcctcancctcccnagtagctgggantacagnngcccnccaccacgcncggctaatttttntatttttagtagagacggggtttcnccnngttngccaggntgntntcnanctcctgacctcgtgatccanccncctcngcctcccaaagtgctgggattacaggnntgagcnaccnngccnngccnnac

SEQ ID NO: 303605 - DNA, 2106 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcaggtacacagctgagtggggagggggctggggcgagcgtggtcctgggggtgggtggcggctgcggtgagcgggccacagccttgggctcccctcagtcccgggcccccactgctggggagctgccattgtctggctcttctctcttaaaatggctgcctgtctgccttcctctccttccctccttcagcctttgtgttgggtttttccagaggtgtctgctcctctttttcctctcccctggtcccttcgaactccaggggtcttgatgggggtgcggggcagagtgtgcggggaagggcctggccgggggtgagggggtgagggggcgctgggggctcaggttaggagtgtaggcagtggtaggagcccaggagttgaatgaacgtttctttgctcacctgccgctcctctccgtcccccggccttcctctgggccgccccccatctgtgctttcaaagagggcccctagagctcgaggggacctcgaggggagggcaggggactgcttgggagctgctagaggccggctgcggttcacctagggcagcccggtccatctcctgtcttaggctccgccggcccagtggcct

SEQ ID NO: 303606 - DNA, 452 bp, Homo sapiens
  misc_feature (430)..(432): n is a, c, g, or t
ggattccaggaaggagcaagcagcagttcgtggtgaagataggaaaagagtccaggagccagtgcgatttggtgaaggaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagcagacaggattccaggaaccagtgtttgatgaagctaggactgaggagcaagcgagcaagcgagcaagcccacgtcaggcctggcctcatctcagaccctgcttaggatgggggatgtggccaggggtgctcctgtgctcaccctctcttggtgcatttttttggaagaannnaattgcctctctcttaaaaa

SEQ ID NO: 303607 - DNA, 8595 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303608 - DNA, 7356 bp, Homo sapiens
tggatctcaagcagtaccacagttacaaagtagtttttagcttagcttacaaggtgttttcacaaataggtggtattttcatttttcaaatgacaaaattagggttctgaggcgggtcagttgacttaaaggttactaggttggtctcattgctctttcaaagtaactgtatttctttatagcatacagactaaaaaaacctgtgtacctgggttatatattcggtggccagaggccatcaaagctcaggttaatgaaatgctctttattttgtagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303609 - DNA, 8729 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
  misc_feature (8678)..(8678): n is a, c, g, or t
  misc_feature (8715)..(8715): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatgggtggaggcaggaggatcacctgaggtcaggaatttgagaacagcctgggccaacacagtaaaactccatcttccaccaaaaaattacaaaatttggcccangggcatgggtggggcaccatgccctgtaaaatccccngcttacttcagggg

SEQ ID NO: 303610 - DNA, 8525 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatattatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303611 - DNA, 6541 bp, Homo sapiens
tcagtgtcctggttggtcttgaagatgatcgggtcatctgtgttgagcgagtagttagcctggtcatttttgagcttgcagaagagggaggaggagtgaatcagcctcaacagtccatctgacccatcttaagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303612 - DNA, 7703 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303613 - DNA, 8192 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303614 - DNA, 7793 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcaggtaagtgctagtcattctcactagggatttcttcaagagtcacatcacagctaaacttactggacttgagaatttttttctcttttacagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303615 - DNA, 7897 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatagttcagcgtctgacgggtacgagatcaa

SEQ ID NO: 303616 - DNA, 6319 bp, Homo sapiens
aactcaggggcgagctgctaactcaggggcgagctgccatacagactaaaaaaacctgtgtacctgggttatatattcggtggccagaggccatcaaagctcaggttaatgaaatgctctttattttgtagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303617 - DNA, 5898 bp, Homo sapiens
  misc_feature (6)..(7): n is a, c, g, or t
agctanncacaggggcaagtccaacatagacactgcaaagggactagacccacatgaccgccagagaattattattattattattttttgagacggagtctcgctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303618 - DNA, 5912 bp, Homo sapiens
gcagacaacgccatcctaacatccacacccatatccggtctgagttacaaacaggaaatccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303619 - DNA, 4448 bp, Homo sapiens
ctggtggttggggaagccgcggtcgtgagagttctgctggtaaggagactgagcctgtggctgtgagtaggggggctggctctgggggtgctgctgtgtcgtcgactgctgggaggggtatggagccggggactgctgatgtggaggctgggatggctgctgggagtatggagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303620 - DNA, 3891 bp, Homo sapiens
acaggggcagagggaccatatgggggctggcgtgtgccatgggaaggccacgagccttcgtggttggccctctgatctgtgtgcagcatttcatctgttcggttcacgaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303621 - DNA, 1442 bp, Homo sapiens
tactagcctatagcgttgactaacttcctatgtgttcagcattcatcgtgatctactgtttctttgatggccattcttgattggagaaacccctggctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303622 - DNA, 670 bp, Homo sapiens
tacatatacaatcagctcgtacccaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaaaaaaaaagtgaa

SEQ ID NO: 303623 - DNA, 2628 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgtgagtatttctgcaccttctgaaaggtgataggggcagagaggaaaccaatgcaaactagttagtttctggttggaagtttagctaattttgacctaaatgaataagttatttcttgaattcaaggaacttaaaggctgacttgtagatgtctgttctgtctccctgcccagggaataggtttgtgatctgtttagtttgtttttgtctttttaagtcttgtgcttttagacatggacccacatgaggggcagagaagatggagatatcagaagcactgtctgctctccatcaaagttgagaaaaatatcagtttcttgactttactct

SEQ ID NO: 303624 - DNA, 2593 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccagcaacagatgcacctggcaccagtggcatcgacacatatgatattcttgaaccga

SEQ ID NO: 303625 - DNA, 2355 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctccatccagtccaatggatcagatgggcaagatgagacctcagccatatggcgggacc

SEQ ID NO: 303626 - DNA, 2043 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcacaaacgagcacagcacacacacgagcatacagcataagcaggtaccgactga

SEQ ID NO: 303627 - DNA, 2061 bp, Homo sapiens
  misc_feature (488)..(488): n is a, c, g, or t
  misc_feature (501)..(501): n is a, c, g, or t
  misc_feature (579)..(579): n is a, c, g, or t
  misc_feature (599)..(599): n is a, c, g, or t
gaattccgaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgcctcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcgggggncgaggcggcggcngcggcagcggccgagcgcggggaaatgaaggcagccgccgggcaggaaagcgagggccccgccgtggggccgccgcanccgctgggaaaggagctgcnggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtctatgagacccacaagcttttgttctctcagtacttgttacccagcttctcaacatccagggcccaatttccactgcctggagttcccctggctctaggacactctaacaagctctgtccacgggtctccccattcccaccagcactgcacacacccactccgtaacctctccactgtacctgcgaacctatgagggatcctctagatcaca

SEQ ID NO: 303628 - DNA, 347 bp, Homo sapiens
acatgattcctatggcaatcagttctccacccaaggcaccccttctggcagccccttccccagccagcagactacaatgtatcaacagcaacagcaggtgaggagggtagctgggaatggactggcatgcaggttcgccttgaaaactagttagtaaactaatctaacgtgttgaagtctaagaagctcactttagatattttggcattcttctctcacctgactggccagtcctgcctgaagagccacgtcctcaatctcttctctatttggagttggaaggggctagaaatagaccttattttgatttttaggttttgtatatttttctacttaagcaagggaag

SEQ ID NO: 303629 - DNA, 364 bp, Homo sapiens
accagcagcagcaacctcagcagccagcaccctcgacgctctcccagcaggctgcgtatcctcagccccagtctcagcagtcccagcaaactgcctattcccagcagcgcttccctccaccgcaggtaagatatccctgcctcctgcccttccctgtgtgtgactacagacagcttgggggttagtgtcatgagaactttgctgtacagagtggttctctaacgtgcacttaaagaccaattaaactctgggtaaacatgataactggattgattgaactaataaaggcataacctccttaactgcataaagacctgtagctctccttaatgatgaagaaatagggcaatggaaagttgcatag

SEQ ID NO: 303630 - DNA, 480 bp, Homo sapiens
ctctcaaacttatgttgcccaaatagtaaatagtgtaaattttcagtggataaatgtagtccacttgtaaacaaaccacctaaaaacccagcttggccgtccttcctggctcagtttaggcagggtgagagaaaaaccctgggcctcctaagtatgaggccttgcatgcttgctttctatactcatcatcagtgcatagcttctcacaaaacacttcatctttcctcatgcaggagagtcagtgctaaaagtatattttcctttcctacagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactccca

SEQ ID NO: 303631 - DNA, 3270 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 303632 - DNA, 1535 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtgagcatcaccagagctgccgtaattgagcacctactacgggctctgtgctgagtccttccagtgtgcctctcactgaatcctcaccccactgccatgaggtttcccccatttgactgatgagggtgcagagccagggag

SEQ ID NO: 303633 - DNA, 3401 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctccaaaaaaaaaaaaaaaaaaaaaaaaaaaaaaaacgggggttttttgggggggaaaaaggttaaaggggggggaatgttcgagacctttttgaaaagggggaatgggggccaaaggggggaaaagaaagcggca

SEQ ID NO: 303634 - DNA, 3215 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 303635 - DNA, 3247 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttgggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 303636 - DNA, 3111 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaaggtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 303637 - DNA, 3316 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctccagcggctgtgtgcaatggggtcttttgtggaaatcaaggagcagaca

SEQ ID NO: 303638 - DNA, 2962 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 303639 - DNA, 2566 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacggaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 303640 - DNA, 1918 bp, Homo sapiens
cccaacagtacggcccagagcgtcgaagttcgctccgaatgtaccaggagtcatgccagcgctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 303641 - DNA, 3194 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 303642 - DNA, 2773 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcatgacgcactggatgccccccctgatgccatcacagatgccccccgatggtcagc

SEQ ID NO: 303643 - DNA, 1937 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 303644 - DNA, 1680 bp, Homo sapiens
agcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcgcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 303645 - DNA, 214 bp, Homo sapiens
caaggtggagcacgagagctttgagaagcctcagctgctgactgtgaacctcaccgtgtactgtgagtgtgcccaagtcagcgatggcaagaacccctgccgggctgcccccaccactgtctacactgactccccaaggcactgtaggcattgcttccatcatctgcaccggctcccctgactcctgtctacacgacccacccccattgtctgc

SEQ ID NO: 303646 - DNA, 407 bp, Homo sapiens
acagagatggaatttgaacccatccatctggttccagagccaggctcgatatttatggatatttcataaccaagtgaataactggatggctaaatccttagaaagcacaccctccatccctgtctgacacacgtgtataccattaagggaaatggcacccccatgtaatagcagaggcagaacttgacattttcagggccctgacacccaggcatgtcttcttcccatgcttcccagcattattccttcctgacgacttcccctcctatttccccagtacagagcatgccagcgcctcagctaatggggtaagtgcagtgttggagctaaggagggtgtggggtctgcacgaactacagaccagacgtcttcagatgcccacggcccggcctcaggagcctgggtct

SEQ ID NO: 303647 - DNA, 381 bp, Homo sapiens
tctgggattataggcgtgagccaccccgcccagcaaccatgccatcctgtacccttaatgaatgcccccttctgccacggaggggttcattgaatgacttgttgcttttgttcctcttcccagccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttg

SEQ ID NO: 303648 - DNA, 932 bp, Homo sapiens
ctgctccactcttggaataaatgaaggattgttggttcaggatatgcagaaagctgcttagcaaaaggagagttggagaagcatcttggtttgagggtcttgaaggacacctactgtactcccagctgagaggactctttctcctcatcttcaggaggatgcctccagagcctggggttactgtaggcctttgccagaggcatgttcggacttagccagctgagtatcccctgtttcctgcttttaccatctcagctgctggtcaggaggtttgggaaggtgacatcatctagctgaatcagctgctgcttctagatacattactggaactgaaagtcattaccccttccttcctgctctgcaagtctcttcagaatgaggctggagtatgggtgttccacctgtctgcagggtcatgactggaatggtacttgctgcttttaaagagctaaaaggtttttaaaagcttgttcatggaaaaagctttcctcaaggcttctcaagctaagggaacagagcgtccttgagaggcaggaggattcacaggaaggccctccccgactccctcttgtccacctacatttagccatatgacccttctgatctcctttgcctaagtccgaggcttaggcctagcactgtaggatgggtaaacaaaacgttatttgtggactttttgaccttaagacttttagagtctggtcaaggggacaaaaaaaaactgcttacatttcagagcagaccagccaccacactattggagatatattggagatctccccttgactcactaattgaaaagcaaaaaagggcaggtgtggtggctcatgcctgtaatctgagcactttaggaggctgaggcaggcagattgcttgagcttaggagtttgagaccagcctgggcaacatggcgaaactctgtctctacaaaa

SEQ ID NO: 303649 - DNA, 675 bp, Homo sapiens
ggaagaggagaggataccggtacgagatagtgctcgagggggatagtagctgttctagatacattactggaactgaaagtcattaccccttccttcctgctctgcaagtctcttcagaatgaggctggagtatgggtgttccacctgtctgcagggtcatgactggaatggtacttgctgcttttaaagagctaaaaggtttttaaaagcttgttcatggaaaaagctttcctcaaggcttctcaagctaagggaacagagcgtccttgagaggcaggaggattcacaggaaggccctccccgactccctcttgtccacctacatttagccatatgacccttctgatctcctttgcctaagtccgaggcttaggcctagcactgtaggatgggtaaacaaaacgttatttgtggactttttgaccttaagacttttagagtctggtcaaggggacaaaaaaaaactgcttacatttcagagcagaccagccaccacactattggagatatattggagatctccccttgactcactaattgaaaagcaaaaaagggcaggtgtggtggctcatgcctgtaatctgagcactttaggaggctgaggcaggcagattgcttgagcttaggagtttgagaccagcctgggcaacatggcgaaactctgtctctacaaaa

SEQ ID NO: 303650 - DNA, 2611 bp, Homo sapiens
tgcggagcgcgcacgcgggaacccgcgctggaggcgggcgagggccgaggggcagctagggagcgcggcttgaggagggcggggccgccccgcaggcccgccagtgtcctcagctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcgctgcagggaagtcaacatttgtgaatatccttaaacaattgtgtgaagattgggaagtggttcctgaacctgttgccagatggtgcaatgttcaaagtactcaagatgaatttgaggaacttacaatgtctcagaaaaatggtgggaatgttcttcagatgatgtatgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatatttttgcatctaatttgtatgaatctgaatgcatgaatgagacagagtggacaatttatcaagactggcatgactggatgaataaccaatttggccaaagccttgaattggatggaatcatttatcttcaagccactccagagacatgcttacatagaatatatttacggggaagaaatgaagagcaaggcattcctcttgaatatttagagaagcttcattataaacatgaaagctggctcctgcataggacactgaaaaccaacttcgattatcttcaagaggtgcctatcttaacactggatgttaatgaagactttaaagacaaatatgaaagtctggttgaaaaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgatcagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattatttatttgtcatgactcaaaaatt

SEQ ID NO: 303651 - DNA, 2600 bp, Homo sapiens
  misc_feature (2597)..(2597): n is a, c, g, or t
tgcggagcgcgcacgcgggaacccgcgctggaggcgggcgagggccgaggggcagctagggagcgcggcttgaggagggcggggccgccccgcaggcccgccagtgtcctcagctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcgctgcagggaagtcaacatttgtgaatatccttaaacaattgtgtgaagattgggaagtggttcctgaacctgttgccagatggtgcaatgttcaaagtactcaagatgaatttgaggaacttacaatgtctcagaaaaatggtgggaatgttcttcagatgatgtatgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatatttttgcatctaatttgtatgaatctgaatgcatgaatgagacagagtggacaatttatcaagactggcatgactggatgaataaccaatttggccaaagccttgaattggatggaatcatttatcttcaagccactccagagacatgcttacatagaatatatttacggggaagaaatgaagagcaaggcattcctcttgaatatttagagaagcttcattataaacatgaaagctggctcctgcataggacactgaaaaccaacttcgattatcttcaagaggtgcctatcttaacactggatgttaatgaagactttaaagacaaatatgaaagtctggttgaaaaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgatcagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaacacccgcatgttaattacaattgccgctctggntcc

SEQ ID NO: 303652 - DNA, 2557 bp, Homo sapiens
tgcggagcgcgcacgcgggaacccgcgctggaggcgggcgagggccgaggggcagctagggagcgcggcttgaggagggcggggccgccccgcaggcccgccagtgtcctcagctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcgctgcagggaagtcaacatttgtgaatatccttaaacaattgtgtgaagattgggaagtggttcctgaacctgttgccagatggtgcaatgttcaaagtactcaagatgaatttgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatatttttgcatctaatttgtatgaatctgaatgcatgaatgagacagagtggacaatttatcaagactggcatgactggatgaataaccaatttggccaaagccttgaattggatggaatcatttatcttcaagccactccagagacatgcttacatagaatatatttacggggaagaaatgaagagcaaggcattcctcttgaatatttagagaagcttcattataaacatgaaagctggctcctgcataggacactgaaaaccaacttcgattatcttcaagaggtgcctatcttaacactggatgttaatgaagactttaaagacaaatatgaaagtctggttgaaaaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgatcagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattatttatttgtcatgactcaaaaatt

SEQ ID NO: 303653 - DNA, 1685 bp, Homo sapiens
tcgacccacgcgtccggacccacgcgtcgcggacgcgtgggtcgtatcaagaggtgcctatcttaacactggatgttaatgaagactttaaagacaaatatgaaagtctggttgaaaaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgatcagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattatttatttgtcatgactcaaaaatt

SEQ ID NO: 303654 - DNA, 5273 bp, Homo sapiens
ggaatggagggctgccacaataatggaaatggtaaatgaggcaaataaggttggactggtggcatagcgtcaaggttgccagctttattaaatcactcttccaatatgctagcactggcctgttgggaaaagtaatatatcatgtaatcgaacaaaagacaaacagaggcaagctccaggaatgggcactgtaaacaggacttgccccagagtagccagatgtaggctttagataagttgatgcaggctgagcatctctaatctgagggggaatgtctcacatggtgtccaagaaatggtgacacatctcacagagggtctaggctcaggagggctagagtatgagacgttccccctcgcctgtgaacttaaaaatgtggccaacaatttttgtaaaagatggctactctgtagtgctttaactggacctatttagacaatgccttacacactggaggacgatactgtgtaaatctaataagtctacaagacaatacttctgtcttttggctctctccttcctctccagggtgatgacaaatccgtgagggtggagattatacctctctcatcatttcagcaccaaggaaataaattagtggcagagtaagggtgacttgatgagtacatccaattgttgacatagttttgggtggagaaattttgctattatatcgacttcttaaaatagtctagtgggattaacttggtttcaattcacagagatctggaagcgaggatcttttaaaaatcctgaaatatacactgcaataaaagaacaaagcatacacctcagccttaaatgactgaagaagtatgtcaagtagcagcaggtgggaaagtggctttggttttcagtttgtgagctctgaatccacacagaaacaggactgcattctgacaacctgaattaattattgtccttaccacaatgaggcagaaaagtataataaaaatcattagtatttcagtcacaattaatgccaagatgagtttgtcagtatagccatatcctggaacttattttgtgagctaaaaaaaacaaaaaaacaaaacaaaaaaaaacacaccagaatgagagctaactattcaaaaccccagtattccaggtgagtagcttacaggttcttttttatttttttgaaagagggtctcactctgttacccaggctggggtacagtggtgcaatcaccgttcactagactcgacctccctgggctcaggtgaccctcccacctcagcctcccaagtagctgggactacaggcacgtgtcatcaacccagctaatttttttattttttgtggagacaggctttcactatgttggccaagctggtctcaaactcctgacttcaagtaatccacccaccttggcctcccaaagtgctgagattacaggcatgagctaccacccctggcctacagttcatcttgtgccctaatctatatttcactctctacatgagcaaagtgggagatcactgtcatgaccaaagttacatggccaagataagctatggcctgggagtcccagattcttctgtgtgggcactttcctgggatatgctaaatgatgggaaatctgggtctcatgtttctgtgtggtcctcacctcaagcgacttctctttctgttcactctgggcttccgtgctctcattaatgtagttctgagtcttccattggtccgtatcccattctatctcagatgcctttacttcctgctgcccactgagaagcttcatcaggtggcctgtcctggagatgagcttggcacaggtcacttgcacatgggccccagagcagtccatcttcaaggtccggataacatgagaaatgagccttctcacattgttggggataagggactgtagctgctgggttagctgaatttcaaactgagcaatgggtaattgaagcttttgggctcgggggacaggtcagtgcccacgttgttgtattcccattttgtctcagtttgtttaacagttggccctaagttgaatgcagtcccagcggaatctgcctcaggaggatgattgtagtttgtgttttcagagatggtgacttctggcatgttagtgttttccataaaaacattttcttccaaggcatttcttgcagttgtgtcttttatattagtggtttctataaaatgttctgaaggagcagatacttccagaaaagggttttcttgaggactcaggtctcctaaggatgaaaaagccccttgtgaaggggaatttatgaggctcttcgctgcagagaacggaggcctgtttgcgagcatcagtctactcagataacttttctttctgaactttggactctttttgaccttgggtgttctgtgggtcatgcgggagcgagttttgtgaaagcggtatttttttctggaatgtgaaattggtttagaagccttcatatttgtaactctagcctttgcactttctaaaatggaaatagtgtgtgtgttgtctttccatctgtctctcacctgtggtagggcttttgcagggctggaggtagaaggcgcgcccttggagaagggtgtcagcacagagactgctgccttatgctcttgggtgaacgaaggcttggtgtagatggcgtttcccgctaacttctcaggcccctgctgtgtgtgaggctgttccagctcccttggggctggactcccgagccttttttcttcggcagcgttctccacagatgcctgggcaccctgttccctcctgatgctctgccttcccacctctttgaagtgccttttctggatgctccttgggcccatgaggactctattcactttttgctggttttggcctacagtttgaatctttgccaggctgtttcctgtggttggcagtttaatgaacggtagtaacattgattccacatctaggtttactgctgagaaatatggcaaatgtaacttagtgcactgataacctcactctcgtcattggtgtctagctgctcactcccaaagcctgacaagttgatgccactgctgtctgagggctcctccggctcaacagtcagctcagtgcttgtgtaattcttccgggcttgtaacgtcttcatgaatgctccttctggattccctacagattcttcttcagctgtcaaaaaagagactgctttgctcatgaaagatgatgggatgggatgcatcagtccatagctgtacaccccagtcacacagagtaggagtcagcaaacatttgagtgccattcagagaggagacacacacacccaatcctaaacctatgaaatggcaacaacaaaaggagaaaatatatcttttgaaaacacggccatctacttggaacattccatagtgtgacatagagtaactctgcttaggattatttcattgatccccagggtccaattgcccagtgctcagtcaaagcccaaggtggaagacaagtgcttccctgatgagctgatgagctggcctctctgcagactgctccataccctgtgctgtcctgcctcagatgcagagagagcacaaggctcccgctctcctcgtcctcggtgcgcctgtgttcttgctaccatcacagctgaatgcaatgaaaggcggtcctctgagaggagcagggtggagatgctaaagtggaggccccctcccattgctgatagatcctcatctggcatgcgctccaccctccccattctctgctcccacatatcgtagccccatcacagaagatgcgacatggaaaaaagcactgtgtccaccctagttcttaaatttgggcagggatttggggtgtatgttaagagtttttcaaatttgccagattgcatgcctatgttgttaaatacacagtgaatctctggtatgatagcagtttctggataaacattacttgaggtcctaaaatgcagaagggaaaaagcaacttttgtcagatgcctactttgctttcatttcatctctaatattttggatggggaatcagccaaagcttctgactgcatgaaggtcaagtgtgccagtgtgcagctgggtttcttttccagaattaaaagtattttgggtggtggtgagggtcagaggaagaagtaaagattgtgagaaagtggaagaagcatgggcttggggagaacccagaattggggccagaagacctggcactaggctacagcacttagcacctctgatcttgtttttcttcatctgtaaaaggaggttaacaaagcttttctgcccacttcttggggagaagggaataatataattggtaaaaaaaaaaaaaaaaagttttgaaaaataagcaacactgactttatgtaaccaagcattattaattctccaccccatatcactggtagatacctgtattcaagctatctggacatgaaagtagtcacattttagaagtcatgaagttgatgctaataaacctaatctacagaaacactcttgaaagcccttgagcatttgttctgtgaacagaaaggtttgagattcagagcaagttcagagttggatggtctaagaatggaaaagccctccattctattagaagagccaggtagcaatttctggttatggaaccagaagctctcaggcttcaaataaaacagcatcacttgtactcttataaaactgtaaaaacagaaaaaccgaaaccgtatctacatctgtcctataaggcagagagtacttgagacctcatgaatttaaaaccaccttacaaactactttgcactatatgaagaaattatcactgtgggcaaagcatcaagcagagagcacagtacacagtgtgtggatgttaatgttattctctagccttcccattcctttgtcttggtcctttgtgcatatggaacagttctattattaaattttgtaatagtaactgagaacctgactctcagcaagggagtagttcagaaattgagggagtttaactctgaatgagtaaataaaaataaagcaattatgtcattagcttaaaattttatcatcattaaaaataaaaagtttaaaaacaaatacttaatgtaacaatttatcaccgcgcaatttggactcacgacaatgtatggtgtttgtcagacatgcactgttgcaatgcagcttgactgtcttgcagacagcctcaatgctgtttttaagttggcagaggcagcaggccatatggctaggtaagatctgggcatggtggcacgtgcctgtagtcccagctactcgggaggctgaggcaggagaattgcttgaacccgggaggcggaggttgcggtgag

SEQ ID NO: 303655 - DNA, 5015 bp, Homo sapiens
ggaatggagggctgccacaataatggaaatggtaaatgaggcaaataaggttggactggtggcatagcgtcaaggttgccagctttattaaatcactcttccaatatgctagcactggcctgttgggaaaagtaatatatcatgtaatcgaacaaaagacaaacagaggcaagctccaggaatgggcactgtaaacaggacttgccccagagtagccagatgtaggctttagataagttgatgcaggctgagcatctctaatctgagggggaatgtctcacatggtgtccaagaaatggtgacacatctcacagagggtctaggctcaggagggctagagtatgagacgttccccctcgcctgtgaacttaaaaatgtggccaacaatttttgtaaaagatggctactctgtagtgctttaactggacctatttagacaatgccttacacactggaggacgatactgtgtaaatctaataagtctacaagacaatacttctgtcttttggctctctccttcctctccagggtgatgacaaatccgtgagggtggagattatacctctctcatcatttcagcaccaaggaaataaattagtggcagagtaagggtgacttgatgagtacatccaattgttgacatagttttgggtggagaaattttgctattatatcgacttcttaaaatagtctagtgggattaacttggtttcaattcacagagatctggaagcgaggatcttttaaaaatcctgaaatatacactgcaataaaagaacaaagcatacacctcagccttaaatgactgaagaagtatgtcaagtagcagcaggtgggaaagtggctttggttttcagtttgtgagctctgaatccacacagaaacaggactgcattctgacaacctgaattaattattgtccttaccacaatgaggcagaaaagtataataaaaatcattagtatttcagtcacaattaatgccaagatgagtttgtcagtatagccatatcctggaacttattttgtgagctaaaaaaaacaaaaaaacaaaacaaaaaaaaacacaccagaatgagagctaactattcaaaaccccagtattccaggtgagtagcttacaggttcttttttatttttttgaaagagggtctcactctgttacccaggctggggtacagtggtgcaatcaccgttcactagactcgacctccctgggctcaggtgaccctcccacctcagcctcccaagtagctgggactacaggcacgtgtcatcaacccagctaatttttttattttttgtggagacaggctttcactatgttggccaagctggtctcaaactcctgacttcaagtaatccacccaccttggcctcccaaagtgctgagattacaggcatgagctaccacccctggcctacagttcatcttgtgccctaatctatatttcactctctacatgagcaaagtgggagatcactgtcatgaccaaagttacatggccaagataagctatggcctgggagtcccagattcttctgtgtgggcactttcctgggatatgctaaatgatgggaaatctgggtctcatgtttctgtgtggtcctcacctcaagcgacttctctttctgttcactctgggcttccgtgctctcattaatgtagttctgagtcttccattggtccgtatcccattctatctcagatgcctttacttcctgctgcccactgagaagcttcatcaggtggcctgtcctggagatgagcttggcacaggtcacttgcacatgggccccagagcagtccatcttcaaggtccggataacatgagaaatgagccttctcacattgttggggataagggactgtagctgctgggttagctgaatttcaaactgagcaatgggtaattgaagcttttgggctcgggggacaggtcagtgcccacgttgttgtattcccattttgtctcagtttgtttaacagttggccctaagttgaatgcagtcccagcggaatctgcctcaggaggatgattgtagtttgtgttttcagagatggtgacttctggcatgttagtgttttccataaaaacattttcttccaaggcatttcttgcagttgtgtcttttatattagtggtttctataaaatgttctgaaggagcagatacttccagaaaagggttttcttgaggactcaggtctcctaaggatgaaaaagccccttgtgaaggggaatttatgaggctcttcgctgcagagaacggaggcctgtttgcgagcatcagtctactcagataacttttctttctgaactttggactctttttgaccttgggtgttctgtgggtcatgcgggagcgagttttgtgaaagcggtatttttttctggaatgtgaaattggtttagaagccttcatatttgtaactctagcctttgcactttctaaaatggaaatagtgtgtgtgttgtctttccatctgtctctcacctgtggtagggcttttgcagggctggaggtagaaggcgcgcccttggagaagggtgtcagcacagagactgctgccttatgctcttgggtgaacgaaggcttggtgtagatggcgtttcccgctaacttctcaggcccctgctgtgtgtgaggctgttccagctcccttggggctggactcccgagccttttttcttcggcagcgttctccacagatgcctgggcaccctgttccctcctgatgctctgccttcccacctctttgaagtgccttttctggatgctccttgggcccatgaggactctattcactttttgctggttttggcctacagtttgaatctttgccaggctgtttcctgtggttggcagtttaatgaacggtagtaacattgattccacatctaggtttactgctgagaaatatggcaaatgtaacttagtgcactgataacctcactctcgtcattggtgtctagctgctcactcccaaagcctgacaagttgatgccactgctgtctgagggctcctccggctcaacagtcagctcagtgcttgtgtaattcttccgggcttgtaacgtcttcatgaatgctccttctggattccctacagattcttcttcagctgtcaaaaaagagactgctttgctcatgaaagatgatgggatgggatgcatcagtccatagctgtacaccccagtcacacagagtaggagtcagcaaacatttgagtgccattcagagaggagacacacacacccaatcctaaacctatgaaatggcaacaacaaaaggagaaaatatatcttttgaaaacacggccatctacttggaacattccatagtgtgacatagagtaactctgcttaggattatttcattgatccccagggtccaattgcccagtgctcagtcaaagcccaaggtggaagacaagtgcttccctgatgagctgatgagctggcctctctgcagactgctccataccctgtgctgtcctgcctcagatgcagagagagcacaaggctcccgctctcctcgtcctcggtgcgcctgtgttcttgctaccatcacagctgaatgcaatgaaaggcggtcctctgagaggagcagggtggagatgctaaagtggaggccccctcccattgctgatagatcctcatctggcatgcgctccaccctccccattctctgctcccacatatcgtagccccatcacagaagatgcgacatggaaaaaagcactgtgtccaccctagttcttaaatttgggcagggatttggggtgtatgttaagagtttttcaaatttgccagattgcatgcctatgttgttaaatacacagtgaatctctggtatgatagcagtttctggataaacattacttgaggtcctaaaatgcagaagggaaaaagcaacttttgtcagatgcctactttgctttcatttcatctctaatattttggatggggaatcagccaaagcttctgactgcatgaaggtcaagtgtgccagtgtgcagctgggtttcttttccagaattaaaagtattttgggtggtggtgagggtcagaggaagaagtaaagattgtgagaaagtggaagaagcatgggcttggggagaacccagaattggggccagaagacctggcactaggctacagcacttagcacctctgatcttgtttttcttcatctgtaaaaggaggttaacaaagcttttctgcccacttcttggggagaagggaataatataattggtaaaaaaaaaaaaaaaaagttttgaaaaataagcaacactgactttatgtaaccaagcattattaattctccaccccatatcactggtagatacctgtattcaagctatctggacatgaaagtagtcacattttagaagtcatgaagttgatgctaataaacctaatctacagaaacactcttgaaagcccttgagcatttgttctgtgaacagaaaggtttgagattcagagcaagttcagagttggatggtctaagaatggaaaagccctccattctattagaagagccaggtagcaatttctggttatggaaccagaagctctcaggcttcaaataaaacagcatcacttgtactcttataaaactgtaaaaacagaaaaaccgaaaccgtatctacatctgtcctataaggcagagagtacttgagacctcatgaatttaaaaccaccttacaaactactttgcactatatgaagaaattatcactgtgggcaaagcatcaagcagagagcacagtacacagtgtgtggatgttaatgttattctctagccttcccattcctttgtcttggtcctttgtgcatatggaacagttctattattaaattttgtaatagtaactgagaacctgactctcagcaagggagtagttcagaaattgagggagtttaactctgaatgagtaaataaaaataaagcaattatgtcattagcttaaaattttatcatcattaaaaataaaaagtttaa

SEQ ID NO: 303656 - DNA, 6292 bp, Homo sapiens
  misc_feature (4741)..(4741): n is a, c, g, or t
  misc_feature (6292)..(6292): n is a, c, g, or t
atcatgggaccgggtgagcgctgagaatcgcggccgcagccatcagccctggagatgaccaggagcggccactgctgagaactatgtggagagaggctgcgagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatanacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtcggatttgaacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagaaacagagaggggaatacttatgcatggggagcctgttagcacagtgcctgccacaaaaacaagtgcccccgacaagatagttgctatgttatgacactttctcagatcaggattttctagtttaaaaattaaatatcataaaacn

SEQ ID NO: 303657 - DNA, 5463 bp, Homo sapiens
  misc_feature (3912)..(3912): n is a, c, g, or t
  misc_feature (5463)..(5463): n is a, c, g, or t
gctctctgctgggtgccaggaacgcagcactgaccacgacaaagcccctgccttagagagatgacgtttctgtataaggacagagacggcaaatggacaagcaagtgaatgaatgtggcaggaagcagtgtggctgggaagaaatacttaaaagcagggcgagagactagagcatattggctgccatttaggcaggaaaaacctcttgtgctgacatttgaagtgaagggacacccatgatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatanacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtcggatttgaacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagaaacagagaggggaatacttatgcatggggagcctgttagcacagtgcctgccacaaaaacaagtgcccccgacaagatagttgctatgttatgacactttctcagatcaggattttctagtttaaaaattaaatatcataaaacn

SEQ ID NO: 303658 - DNA, 3422 bp, Homo sapiens
  misc_feature (1871)..(1871): n is a, c, g, or t
  misc_feature (3422)..(3422): n is a, c, g, or t
tggaaacccagcaaactcagaaacttgtcttaaggttacatagctgtgagttgcacatcgtctgttccaaacccagaagcgtctgccccaaagtgcatgttctggtcctcactgcctgtgaatgttgtgatctgtccaggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatanacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtcggatttgaacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagaaacagagaggggaatacttatgcatggggagcctgttagcacagtgcctgccacaaaaacaagtgcccccgacaagatagttgctatgttatgacactttctcagatcaggattttctagtttaaaaattaaatatcataaaacn

SEQ ID NO: 303659 - DNA, 1396 bp, Homo sapiens
gctctctgctgggtgccaggaacgcagcactgaccacgacaaagcccctgccttagagagatgacgtttctgtataaggacagagacggcaaatggacaagcaagtgaatgaatgtggcaggaagcagtgtggctgggaagaaatacttaaaagcagggcgagagactagagcatattggctgccatttaggcaggaaaaacctcttgtgctgacatttgaagtgaagggacacccatgatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgagcatccttctgtgtgctgaatgcaggggagggaagaaagcatgggcaataaaggggctcacagtgcttctttctcccacgcatttcctgttgagctgctctagatcccatctcacagccaagagcacgtctttcttgcaacaaggcagactaaatctgtaaggtgcaattggaatgctttctctgggtgaactgtggtaattgtgtggtgcgctgtatgtctgttctcaaatcccagtaggaaaggtctgaactaaggataatttaaagacagtgaagtctgggttgcagcattacactaataagtgttgactatgtagcaatgatcatagaagtttgcctaaacttcctaattgtgtaccatagtcattgccatatgaacgaaccctctgtattttcatgtactcagtcttttgctttaaataaactaattttaaaaacttaaaa

SEQ ID NO: 303660 - DNA, 827 bp, Homo sapiens
gatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccgtaagaaagggcttgttgtctcccaaagtgggatcagagttttgctgttgtcattgtttgcttgcttacatactcattgttggaaatacgcactgaaaatgcagaatgttatgtgtttacttacgggacttttattttgctctcctctctctttctttcatctcctttgtaagaaaagtcacattagactttgtttcctgcaacttaacttttttttctactcaacaatatatc

SEQ ID NO: 303661 - DNA, 3435 bp, Homo sapiens
gaattgcggcacgcagcttgcgcgcgccccaccgaccaaaatggcggctgccgttggtgcggggtgcggtttgtagtgctgttgccctactcatccctttgcaaaatgtgaaagaagaagcggctggtggaggcgggccataggcaatgagtcggcgaaggaaacatgatgacagccctagcccgaagaaaacgccgcacaaaacagtggcggcggaggaatgcggctcggtggtcgagccagggaggaggcggctgagatcggcccgcggttcgtggccctgcggggctagagaggggcctcccgggccagtgcggcagcgagagcagcctccgaccgccgccctgtgcagtaaaagtaaccccgaggaaaggtatgaaacaccaaagagagcgctgaaaatggactcactgtcatcttccttcagttctcctaatgatccagatggacagaatgatatcttttgggatcagaattctccattgacaaagcagttaggtaaaggaagaaaaaaacagatttacaccacagatagtgatgagatttcacatattgttaatcgtattgctcctcaggatgaaaaaccaacaacaaattctatgctggacatgtggattggtgaaactgctattccttgtactcccagtgtagcaaaaggaaaatcaagagcaaaaatcagctgcacaaagttaaaaacacaaagtcaagaagaagaacttatgaaactggctaaacaatttgataaaaatatggaagagctagatgtgattcaagagcaaaacaagaggaattatgattttacccagatgatttcagaaacagagattttaagtaattataaagataatatacagatgtggtcattacataatatagttcccgaaatagataatgctacaaaaaagccaatcaaaggaaacaccaagatatctgtggcaaataatcaaaatagcagtcagaagccatttgaccaaattgctgaagcagcctttaatgctatttttgatggttctactcagaaatgttagcggacagttaagccaagaactgccagaggctttttggagcaccagtaatactacctttgtaaagacaaatgctttgaaagaggagaaaatcattactaatgaaactctggtcattgaaaaactgtcaaataaaaccccacgatcactttcttctcaagtagatacacccataatgacaaaatcatgtgtgacttcctgtactaaggagccagaaacttctaataagtacattgatgcatttactacaagtgattttgaggatgattgggaaaacttactaggtagtgaaccttttgctatgcaaaatatcgacatgcctgaactctttccttctaaaacagcccatgttactgatcaaaaggaaatttgtacctttaatagtaaaactgttaaaaatacgtcaagagcaaatacaagtccagatgccaggttaggagattcaaaagtattacaagatctttcttcaaagacatatgacagagaattaatagatgcagaatatagattttcaccaaattcaaataaatcaaacaaattatccactggaaataaaatgaaatttgagaactcttccaataaaattgttattcaagacgaaattcaaaattgtatagttacatctaatctgacaaaaataaaggaagatattcttactaactctactgaagcttctgaaaggaagtcagctttgaacacaaggtattctaatgaacagaaaaataagtgcattttaaatcagtctattaaagcccctgttaatactgatctttttggctctgcaaatctaggcagtaaaaccagtgttagtaacccaaatcagactagtgcatcaaaagtaggttctttctttgatgattggaatgatccctcatttgccaatgaaattattaaagcatgtcatcaattagataatacctgggaagcagatgatgtagatgatgatttgttgtaccaagcatgtgatgatattgaaagactaactcagcaacaagacattagaaaggacagtaagacatcagaaagtatatgtgagatcaataataattccgaacatggagccaaactaactcagcaacaagacattagaaaggacagtaagacatcagaaagtatatgtgagatcaataataattccgaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccaaaattacacagggtgtggagaaaaagaaaggtgtcaacccattactggaggaagctgttggacagcaatctttggtgaaactttctgaatctttgaaacaatcttcaaaagaggaagaagagaaaaatagaaagtgttctcctgaagaaattcagagaaaaagacaagaagcactggttcggagaatggctaaagcacgagcctcatctgtaaatgcagctcccacttcatttctttaatgaaatattagttggaagacttcacaaagactgctgataactatctgtgattgataggaaattttttttcttgatttctctgtgagaaatgtaatgctgacttttataaagcctggacttctactttatttaataaatcaatgtttgcaatggtaaatgaaacatttccttggacatgtatttgaaagtcattaaatacaaaagttttggaaattcaggaaagttagcaattatgtacggatattatacagaggaaagtagttatatttttaaatgctattattgcagaggatcatcaaaaaagaggtaatctacgttatttcctattctaatgtcttttcctaataaaaaacttcaactttctaagttagtagagactgtttttgtagttttactttcattaactgttgcttaagggtttttatacacttccagattttaattaaatactttcatatttctaggaacataggttgatatgaaataaaggactttttatttgtaagg

SEQ ID NO: 303662 - DNA, 953 bp, Homo sapiens
gaattgcggcacgcagcttgcgcgcgccccaccgaccaaaatggcggctgccgttggtgcggggtgcggtttgtagtgctgttgccctactcatccctttgcaaaatgtgaaagaagaagcggctggtggaggcgggccataggcaatgagtcggcgaaggaaacatgatgacagccctagcccgaagaaaacgccgcacaaaacagtggcggcggaggaatgcggctcggtggtcgagccagggaggaggcggctgagatcggcccgcggttcgtggccctgcggggctagagaggggcctcccgggccagtgcggcagcgagagcagcctccgaccgccgccctgtgcagtaaaagtaaccccgagggtgagacgtcggcagcgcggcctgccttggcttcggcgccgcatccccacatcccagcttgcaacagggaaatctggggtgggggtggagtctggagcgtgtattctgtctctgaggatacccctgaaccatcgagagtccaaaaataatcctataccactccccgatgggcttttgtccccgaacttcagcactaccccgttaggtttgaccatccatttgcctccgccacaggaataggtaatgtggtttacctgtttgcgggagggcggctgctttccaggctgctcctccagtcagcagcagtggtggagtgagaagaaacagctgataggcccgctaacctcagtttttgcccggagaagttatttctctttaaaccctttttttccctgtgacctgctttagagaagagttcataggaaaagttaaagtttgtctcaaagcctggtagatgtctcacctcattgtgaataaaccggaagttcctgtgtgtaacatccctccaaataagatactaaggatctctttcgtctcgatggtgtcaggggatcctcatagaatcgactatcacccaatcacga

SEQ ID NO: 303663 - DNA, 3311 bp, Homo sapiens
cacgagggctaaacatatttaggtttctgttgggttactttggatttttgaatgtacctataaattacagatggttccccaaagcctccaagactcaatggtaataaatagaatgacttaggttatacagtattgtattatgcattcataaagcttctggattatctagaagtgtttgctatttacaatgtgaagtttgcgaagtgccgcgtggatttttatgtgaaacaagcatttctgttacggttcaggtaattatctctgggaaaaaaaattatcttggactataaaagttagtctcagctatttgaccttggggtcttacgaagtaaggtaatgctttaaaatgcaacaattgttattttactcatattttatatagaaaggtatgaaacaccaaagagagcgctgaaaatggactcactgtcatcttccttcagttctcctaatgatccagatggacagaatgatatcttttgggatcagaattctccattgacaaagcagttaggtaaaggaagaaaaaaacagatttacaccacagatagtgatgagatttcacatattgttaatcgtattgctcctcaggatgaaaaaccaacaacaaattctatgctggacatgtggattggtgaaactgctattccttgtactcccagtgtagcaaaaggaaaatcaagagcaaaaatcagctgcacaaagttaaaaacacaaagtcaagaagaagaacttatgaaactggctaaacaatttgataaaaatatggaagagctagatgtgattcaagagcaaaacaagaggaattatgattttacccagatgatttcagaaacagagattttaagtaattataaagataatatacagatgtggtcattacataatatagttcccgaaatagataatgctacaaaaaagccaatcaaaggaaacaccaagatatctgtggcaaataatcaaaatagcagtcagaagccatttgaccaaattgctgaagcagcctttaatgctatttttgatggttctactcagaaatgttagcggacagttaagccaagaactgccagaggctttttggagcaccagtaatactacctttgtaaagacaaatgctttgaaagaggagaaaatcattactaatgaaactctggtcattgaaaaactgtcaaataaaaccccacgatcactttcttctcaagtagatacacccataatgacaaaatcatgtgtgacttcctgtactaaggagccagaaacttctaataagtacattgatgcatttactacaagtgattttgaggatgattgggaaaacttactaggtagtgaaccttttgctatgcaaaatatcgacatgcctgaactctttccttctaaaacagcccatgttactgatcaaaaggaaatttgtacctttaatagtaaaactgttaaaaatacgtcaagagcaaatacaagtccagatgccaggttaggagattcaaaagtattacaagatctttcttcaaagacatatgacagagaattaatagatgcagaatatagattttcaccaaattcaaataaatcaaacaaattatccactggaaataaaatgaaatttgagaactcttccaataaaattgttattcaagacgaaattcaaaattgtatagttacatctaatctgacaaaaataaaggaagatattcttactaactctactgaagcttctgaaaggaagtcagctttgaacacaaggtattctaatgaacagaaaaataagtgcattttaaatcagtctattaaagcccctgttaatactgatctttttggctctgcaaatctaggcagtaaaaccagtgttagtaacccaaatcagactagtgcatcaaaagtaggttctttctttgatgattggaatgatccctcatttgccaatgaaattattaaagcatgtcatcaattagataatacctgggaagcagatgatgtagatgatgatttgttgtaccaagcatgtgatgatattgaaagactaactcagcaacaagacattagaaaggacagtaagacatcagaaagtatatgtgagatcaataataattccgaacatggagccaaactaactcagcaacaagacattagaaaggacagtaagacatcagaaagtatatgtgagatcaataataattccgaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccaaaattacacagggtgtggagaaaaagaaaggtgtcaacccattactggaggaagctgttggacagcaatctttggtgaaactttctgaatctttgaaacaatcttcaaaagaggaagaagagaaaaatagaaagtgttctcctgaagaaattcagagaaaaagacaagaagcactggttcggagaatggctaaagcacgagcctcatctgtaaatgcagctcccacttcatttctttaatgaaatattagttggaagacttcacaaagactgctgataactatctgtgattgataggaaattttttttcttgatttctctgtgagaaatgtaatgctgacttttataaagcctggacttctactttatttaataaatcaatgtttgcaatggtaaatgaaacatttccttggacatgtatttgaaagtcattaaatacaaaagttttggaaattcaggaaagttagcaattatgtacggatattatacagaggaaagtagttatatttttaaatgctattattgcagaggatcatcaaaaaagaggtaatctacgttatttcctattctaatgtcttttcctaataaaaaacttcaactttctaagtta

SEQ ID NO: 303664 - DNA, 3257 bp, Homo sapiens
cacgagggctaaacatatttaggtttctgttgggttactttggatttttgaatgtacctataaattacagatggttccccaaagcctccaagactcaatggtaataaatagaatgacttaggttatacagtattgtattatgcattcataaagcttctggattatctagaagtgtttgctatttacaatgtgaagtttgcgaagtgccgcgtggatttttatgtgaaacaagcatttctgttacggttcaggtaattatctctgggaaaaaaaattatcttggactataaaagttagtctcagctatttgaccttggggtcttacgaagtaaggtaatgctttaaaatgcaacaattgttattttactcatattttatatagaaaggtatgaaacaccaaagagagcgctgaaaatggactcactgtcatcttccttcagttctcctaatgatccagatggacagaatgatatcttttgggatcagaattctccattgacaaagcagttaggtaaaggaagaaaaaaacagatttacaccacagatagtgatgagatttcacatattgttaatcgtattgctcctcaggatgaaaaaccaacaacaaattctatgctggacatgtggattggtgaaactgctattccttgtactcccagtgtagcaaaaggaaaatcaagagcaaaaatcagctgcacaaagttaaaaacacaaagtcaagaagaagaacttatgaaactggctaaacaatttgataaaaatatggaagagctagatgtgattcaagagcaaaacaagaggaattatgattttacccagatgatttcagaaacagagattttaagtaattataaagataatatacagatgtggtcattacataatatagttcccgaaatagataatgctacaaaaaagccaatcaaaggaaacaccaagatatctgtggcaaataatcaaaatagcagtcagaagccatttgaccaaattgctgaagcagcctttaatgctatttttgatggttctactcagaaatgttagcggacagttaagccaagaactgccagaggctttttggagcaccagtaatactacctttgtaaagacaaatgctttgaaagaggagaaaatcattactaatgaaactctggtcattgaaaaactgtcaaataaaaccccacgatcactttcttctcaagtagatacacccataatgacaaaatcatgtgtgacttcctgtactaaggagccagaaacttctaataagtacattgatgcatttactacaagtgattttgaggatgattgggaaaacttactaggtagtgaaccttttgctatgcaaaatatcgacatgcctgaactctttccttctaaaacagcccatgttactgatcaaaaggaaatttgtacctttaatagtaaaactgttaaaaatacgtcaagagcaaatacaagtccagatgccaggttaggagattcaaaagtattacaagatctttcttcaaagacatatgacagagaattaatagatgcagaatatagattttcaccaaattcaaataaatcaaacaaattatccactggaaataaaatgaaatttgagaactcttccaataaaattgttattcaagacgaaattcaaaattgtatagttacatctaatctgacaaaaataaaggaagatattcttactaactctactgaagcttctgaaaggaagtcagctttgaacacaaggtattctaatgaacagaaaaataagtgcattttaaatcagtctattaaagcccctgttaatactgatctttttggctctgcaaatctaggcagtaaaaccagtgttagtaacccaaatcagactagtgcatcaaaagtaggttctttctttgatgattggaatgatccctcatttgccaatgaaattattaaagcatgtcatcaattagataatacctgggaagcagatgatgtagatgatgatttgttgtaccaagcatgtgatgatattgaaagactaactcagcaacaagacattagaaaggacagtaagacatcagaaagtatatgtgagatcaataataattccgaacatggagccaaactaactcagcaacaagacattagaaaggacagtaagacatcagaaagtatatgtgagatcaataataattccgaacatggagccatgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccaaaattacacagggtgtggagaaaaagaaaggtgtcaacccattactggaggaagctgttggacagcaatctttggtgaaactttctgaatctttgaaacaatcttcaaaagaggaagaagagaaaaatagaaagtgttctcctgaagaaattcagagaaaaagacaagaagcactggttcggagaatggctaaagcacgagcctcatctgtaaatgcagctcccacttcatttctttaatgaaatattagttggaagacttcacaaagactgctgataactatctgtgattgataggaaattttttttcttgatttctctgtgagaaatgtaatgctgacttttataaagcctggacttctactttatttaataaatcaatgtttgcaatggtaaatgaaacatttccttggacatgtatttgaaagtcattaaatacaaaagttttggaaattcaggaaagttagcaattatgtacggatattatacagaggaaagtagttatatttttaaatgctattattgcagaggatcatcaaaaaagaggtaatctacgttatttcctattctaatgtcttttcctaataaaaaacttcaactttctaagtta

SEQ ID NO: 303665 - DNA, 1020 bp, Homo sapiens
tttgtttttttggaagacgggggatgctacactggtactttatacctctttttttccctatctgccaaaggatgaaaaaccaacaacaaattctatgctggacatgtggattggtgaaactgctattccttgtactcccagtgtagcaaaaggaaaatcaagagcaaaaatcagctgcacaaagaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccaaaattacacagggtgtggagaaaaagaaaggtgtcaacccattactggaggaagctgttggacagcaatctttggtgaaactttctgaatctttgaaacaatcttcaaaagaggaagaagagaaaaatagaaagtgttctcctgaagaaattcagagaaaaagacaagaagcactggttcggagaatggctaaagcacgagcctcatctgtaaatgcagctcccacttcatttctttaatgaaatattagttggaagacttcacaaagactgctgataactatctgtgattgataggaaattttttttcttgatttctctgtgagaaatgtaatgctgacttttataaagcctggacttctactttatttaataaatcaatgtttgcaatggtaaatgaaacatttccttggacatgtatttgaaagtcattaaatacaaaagttttggaaattcaggaaagttagcaattatgtacggatattatacagaggaaagtagttatatttttaaatgctattattgcagaggatcatcaaaaaagaggtaatctacgttatttcctattctaatgtcttttcctaataaaaaacttcaactttctaagtta

SEQ ID NO: 303666 - DNA, 736 bp, Homo sapiens
atcacactgtgaaaagaatgtatcaaatagagacagatccatcagtgcttgattttcttttgaactggagcattatatctgtattatgtacttagaattttatattcagtagtttagtttgatttaatagccaactaatatggcaaatctgggtgattaaaaaaagcaaaaattaaagcacatattgaatgactttataggctataaaagtaaaactcatcttttgttgaatttttagaggaagaagagaaaaatagaaagtgttctcctgaagaaattcagagaaaaagacaagaagcactggttcggagaatggctaaagcacgagcctcatctgtaaatgcagctcccacttcatttctttaatgaaatattagttggaagacttcacaaagactgctgataactatctgtgattgataggaaattttttttcttgatttctctgtgagaaatgtaatgctgacttttataaagcctggacttctactttatttaataaatcaatgtttgcaatggtaaatgaaacatttccttggacatgtatttgaaagtcattaaatacaaaagttttggaaattcaggaaagttagcaattatgtacggatattatacagaggaaagtagttatatttttaaatgctattattgcagaggatcatcaaaaaagaggtaatctacgttatttcctattctaatgtcttttcctaataaaaaacttcaactttctaagtta

SEQ ID NO: 303667 - DNA, 3094 bp, Homo sapiens
cacgagggctaaacatatttaggtttctgttgggttactttggatttttgaatgtacctataaattacagatggttccccaaagcctccaagactcaatggtaataaatagaatgacttaggttatacagtattgtattatgcattcataaagcttctggattatctagaagtgtttgctatttacaatgtgaagtttgcgaagtgccgcgtggatttttatgtgaaacaagcatttctgttacggttcaggtaattatctctgggaaaaaaaattatcttggactataaaagttagtctcagctatttgaccttggggtcttacgaagtaaggtaatgctttaaaatgcaacaattgttattttactcatattttatatagaaaggtatgaaacaccaaagagagcgctgaaaatggactcactgtcatcttccttcagttctcctaatgatccagatggacagaatgatatcttttgggatcagaattctccattgacaaagcagttaggtaaaggaagaaaaaaacagatttacaccacagatagtgatgagatttcacatattgttaatcgtattgctcctcaggatgaaaaaccaacaacaaattctatgctggacatgtggattggtgaaactgctattccttgtactcccagtgtagcaaaaggaaaatcaagagcaaaaatcagctgcacaaagttaaaaacacaaagtcaagaagaagaacttatgaaactggctaaacaatttgataaaaatatggaagagctagatgtgattcaagagcaaaacaagaggaattatgattttacccagatgatttcagaaacagagattttaagtaattataaagataatatacagatgtggtcattacataatatagttcccgaaatagataatgctacaaaaaagccaatcaaaggaaacaccaagatatctgtggcaaataatcaaaatagcagtcagaagccatttgaccaaattgctgaagcagcctttaatgctatttttgatggttctactcagaaatgttagcggacagttaagccaagaactgccagaggctttttggagcaccagtaatactacctttgtaaagacaaatgctttgaaagaggagaaaatcattactaatgaaactctggtcattgaaaaactgtcaaataaaaccccacgatcactttcttctcaagtagatacacccataatgacaaaatcatgtgtgacttcctgtactaaggagccagaaacttctaataagtacattgatgcatttactacaagtgattttgaggatgattgggaaaacttactaggtagtgaaccttttgctatgcaaaatatcgacatgcctgaactctttccttctaaaacagcccatgttactgatcaaaaggaaatttgtacctttaatagtaaaactgttaaaaatacgtcaagagcaaatacaagtccagatgccaggttaggagattcaaaagtattacaagatctttcttcaaagacatatgacagagaattaatagatgcagaatatagattttcaccaaattcaaataaatcaaacaaattatccactggaaataaaatgaaatttgagaactcttccaataaaattgttattcaagacgaaattcaaaattgtatagttacatctaatctgacaaaaataaaggaagatattcttactaactctactgaagcttctgaaaggaagtcagctttgaacacaaggtattctaatgaacagaaaaataagtgcattttaaatcagtctattaaagcccctgttaatactgatctttttggctctgcaaatctaggcagtaaaaccagtgttagtaacccaaatcagactagtgcatcaaaagtaggttctttctttgatgattggaatgatccctcatttgccaatgaaattattaaagcatgtcatcaattagataatacctgggaagcagatgatgtagatgatgatttgttgtaccaagcatgtgatgatattgaaagactaactcagcaacaagacattagaaaggacagtaagacatcagaaagtatatgtgagatcaataataattccgaacatggagccaaactaactcagcaacaagacattagaaaggacagtaagacatcagaaagtatatgtgagatcaataataattccgaacatggagccaaaaacatgtttgctatatctaaacaaggaagtaatttggtacaatcaaagcatttgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccaaaattacacagggtgtggagaaaaagaaaggtgtcaacccattactggaggaagctgttggacagcaatctttggtgaaactttctgaatctttgaaacaatcttcaaaagaggaagaagagaaaaatagaaagtgttctcctgaagaaattcagagaaaaagacaagaagcactggttcggagaatggctaaagcacgagcctcatctgtaaatgcagctcccacttcatttctttaatgaaatattagttggaagacttcacaaagactgctgataactatctgtgattgacccccccccttttatgttgatttggcgtgaggaaatgagagtgccctttgatgaagcgtggccttggtcttgatttaatagaccattgtttgcgatggt

SEQ ID NO: 303668 - DNA, 2848 bp, Homo sapiens
cacgagggctaaacatatttaggtttctgttgggttactttggatttttgaatgtacctataaattacagatggttccccaaagcctccaagactcaatggtaataaatagaatgacttaggttatacagtattgtattatgcattcataaagcttctggattatctagaagtgtttgctatttacaatgtgaagtttgcgaagtgccgcgtggatttttatgtgaaacaagcatttctgttacggttcaggtaattatctctgggaaaaaaaattatcttggactataaaagttagtctcagctatttgaccttggggtcttacgaagtaaggtaatgctttaaaatgcaacaattgttattttactcatattttatatagaaaggtatgaaacaccaaagagagcgctgaaaatggactcactgtcatcttccttcagttctcctaatgatccagatggacagaatgatatcttttgggatcagaattctccattgacaaagcagttaggtaaaggaagaaaaaaacagatttacaccacagatagtgatgagatttcacatattgttaatcgtattgctcctcaggatgaaaaaccaacaacaaattctatgctggacatgtggattggtgaaactgctattccttgtactcccagtgtagcaaaaggaaaatcaagagcaaaaatcagctgcacaaagttaaaaacacaaagtcaagaagaagaacttatgaaactggctaaacaatttgataaaaatatggaagagctagatgtgattcaagagcaaaacaagaggaattatgattttacccagatgatttcagaaacagagattttaagtaattataaagataatatacagatgtggtcattacataatatagttcccgaaatagataatgctacaaaaaagccaatcaaaggaaacaccaagatatctgtggcaaataatcaaaatagcagtcagaagccatttgaccaaattgctgaagcagcctttaatgctatttttgatggttctactcagaaatgttagcggacagttaagccaagaactgccagaggctttttggagcaccagtaatactacctttgtaaagacaaatgctttgaaagaggagaaaatcattactaatgaaactctggtcattgaaaaactgtcaaataaaaccccacgatcactttcttctcaagtagatacacccataatgacaaaatcatgtgtgacttcctgtactaaggagccagaaacttctaataagtacattgatgcatttactacaagtgattttgaggatgattgggaaaacttactaggtagtgaaccttttgctatgcaaaatatcgacatgcctgaactctttccttctaaaacagcccatgttactgatcaaaaggaaatttgtacctttaatagtaaaactgttaaaaatacgtcaagagcaaatacaagtccagatgccaggttaggagattcaaaagtattacaagatctttcttcaaagacatatgacagagaattaatagatgcagaatatagattttcaccaaattcaaataaatcaaacaaattatccactggaaataaaatgaaatttgagaactcttccaataaaattgttattcaagacgaaattcaaaattgtatagttacatctaatctgacaaaaataaaggaagatattcttactaactctactgaagcttctgaaaggaagtcagctttgaacacaaggtattctaatgaacagaaaaataagtgcattttaaatcagtctattaaagcccctgttaatactgatctttttggctctgcaaatctaggcagtaaaaccagtgttagtaacccaaatcagactagtgcatcaaaagtaggttctttctttgatgattggaatgatccctcatttgccaatgaaattattaaagcatgtcatcaattagataatacctgggaagcagatgatgtagatgatgatttgttgtaccaagcatgtgatgatattgaaagactaactcagcaacaagacattagaaaggacagtaagacatcagaaagtatatgtgagatcaataataattccgaacatggagccaaactaactcagcaacaagacattagaaaggacagtaagacatcagaaagtatatgtgagatcaataataattccgaacatggagccatgaatccaggcagcatttcagtgcagacatctttgacaaatagctcacaaatagataagccaatgaagatggagaaaggggaaatgtatggaaattctccaagatttttaggtgccacaaatttgactatgtattctaagatctcaaactgtcagataaataatctgcatgtgtcttatactaacactgatgttccaatacaagtgaatagttccaaattggttcttccaggaagttcaagtttgaatgtaacttcagatcatatgaatacagaaattactacttataagaagaaattgagtactaatcagccatgccataagactgtaacagatgaagctcagagcaaccttaacacaacagttggattttcaaagtttacatttacaaggatgaaaaattctcagattctttctcagtttaatcaaaattgtataactggaagtatgtctgataccgctgttccacagcactctttgctgaaactttctgaacttttgaaccaatcttaaacgagaagcatagttccttcgaaccccccccccccactctttcacctcctacgccgattgattgttctgcaacaggctaccgtccactcctatctgtactgcagctctacttcatttctttactcgcttctcctctgcttgctcccc

SEQ ID NO: 303669 - DNA, 380 bp, Homo sapiens
gtactacctatcgatttgctcctgcacgcgtatatcgtatgtagctaaacttgtcagtggaagggcggctgctttccaggctgctcctccagtcagcagcagtggtggagtgagaagaaacagctgataggcccgctaacctcagtttttgcccggagaagttatttctctttaaaccctttttttccctgtgacctgctttagagaagagttcataggaaaagttaaagtttgtctcaaagcctggtagatgtctcacctcattgtgaataaaccggaagttcctgtgtgtaacatccctccaaataagatactaaggatctctttcgtctcgatggtgtcaggggatcctcatagaatcgactatcacccaatcacga

SEQ ID NO: 303670 - DNA, 634 bp, Homo sapiens
gcggccgcctactactactactgctcgaattcaagcttctaacgatgtacggggacatgtcaggcattttgcaaggaaaagccacttggggaaagatggaaaaggacaaaaaaaattaataaatttccattggccctcgggtgagctgagggtttttgcaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacgagggggggacggacgcgaagacacgaatcacctccgacgcgaggggcgccagactcgcaccgaccggcgcacccgagctatgctagaaatcaagagagggcggcgcacacacaagcacgatggatcgaacactaacacaacagcaacgcagggcgggcggggatcacagcaacacaaaagcagacggcgaagcaacaaacacggaggcgtaggacgcgacacggaaacgaacaaacacacatacggggcggagaagcaacaccgcaaggcaaccaccacccaccaagaggaaagtagaccacagagaggcggaaaacaaaaacccaccgtacgagcagtg

SEQ ID NO: 303671 - DNA, 880 bp, Homo sapiens
cctcggtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacgagggggggacggacgcgaagacacgaatcacctccgacgcgaggggcgccagactcgcaccgaccggcgcacccgagctatgctagaaatcaagagagggcggcgcacacacaagcacgatggatcgaacactaacacaacagcaacgcagggcgggcggggatcacagcaacacaaaagcagacggcgaagcaacaaacacggaggcgtaggacgcgacacggaaacgaacaaacacacatacggggcggagaagcaacaccgcaaggcaaccaccacccaccaagaggaaagtagaccacagagaggcggaaaacaaaaacccaccgtacgagcagtg

SEQ ID NO: 303672 - DNA, 149 bp, Homo sapiens
ttgaagtaatgactgatggtggaacagatgcagagaggtcacacagccagtgcacagcaattcctggtgcgcacccgtggggcagcctgcccagagtgcagcagtcattgtagtactactcactgtccccacctgaatttgtggactgc

SEQ ID NO: 303673 - DNA, 168 bp, Homo sapiens
gcggccgcctactactactactactgctcgaattcaagcttctaacgatgtacggggcatgggactggcccaggcacacaggtcccggggcatcaggagaaaggctgggtcttgggaccttgtcctccccagttggcctactgttacacattaaaacgatttgcccag

SEQ ID NO: 303674 - DNA, 1775 bp, Homo sapiens
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303675 - DNA, 1313 bp, Homo sapiens
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccag

SEQ ID NO: 303676 - DNA, 948 bp, Homo sapiens
  misc_feature (864)..(864): n is a, c, g, or t
  misc_feature (866)..(867): n is a, c, g, or t
  misc_feature (871)..(871): n is a, c, g, or t
  misc_feature (879)..(879): n is a, c, g, or t
  misc_feature (881)..(882): n is a, c, g, or t
  misc_feature (890)..(890): n is a, c, g, or t
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagccaccagaggagtggggancnntggngtcatgancnngataaacnaaaattaccgaaatccatgtgccggcggaacccctgtggaaaattttttccgaatctg

SEQ ID NO: 303677 - DNA, 892 bp, Homo sapiens
cgggtgtgaatcggacgaggaaaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303678 - DNA, 430 bp, Homo sapiens
cgggtgtgaatcggacgaggaaaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccag

SEQ ID NO: 303679 - DNA, 315 bp, Homo sapiens
ctctatgtgcctgctctctatgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccag

SEQ ID NO: 303680 - DNA, 290 bp, Homo sapiens
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaaggtaagtgttggaaaccactgtcctttg

SEQ ID NO: 303681 - DNA, 1618 bp, Homo sapiens
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagaaaaaaaaaaaaaaataaaaaaaacaacaaaatttggtggggcgcgcagcgccccagaaagaaagttctaaaaaccatctgtgggaggcagggcccagagtgtaggcacctgcggcaagacgtgggacaagggaacacccgcgccagcgcctggggtcgggttctcaccataaaaaaccgcgcgacccggggcgtcggacacacccaagggggtctggcggcacgggtttacaggggcaggctacccccacccgccgcgacagagaaccgaaacacagcgaacacgcagaccacaacacaatgag

SEQ ID NO: 303682 - DNA, 1579 bp, Homo sapiens
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagaaaaaaccagagccaaccgcacaccccagggacctactacacgcaccagacgggcccaaaccaggggcactggaaccgcggccagcggcaacacgcggcgcccggagcacccagcgctgcctgtgcaacaaagcgggaacaccgcgcggtcccccccaaaagcgcgccggcccgacgtcgccacccccggtaccccgcaaagggcgcgcacaccagccccctacccccgcgacccgcccccgcggccacacgaccccgccgtacca

SEQ ID NO: 303683 - DNA, 2218 bp, Homo sapiens
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagtgagcaattcagagacggggttgggggaccgtgggtgcctgggggcttagacttcggtgacagcagtgagtggatcactgcgctgcctcaggagctgccctgccccctttccagccatgtttatggctttatggctttggcttgcctactcttgtcatttgctgaggtcatcttgagggcaaggccggctcatggtgcatgataggagggaaggggtaacaggcggtcattgccacctacaggaaaacaatgccagtgttggtgcctcagcttccagcctcgggactcaaatgcgtctcagataccctgggccctgctcctgcccagcctggcttggtgttgctgaggtctaaagagattagacttgacacgggggtgctgggagaagggacagctttagaagagaaggatgagctgtttcatcttgcttccgtttctccaggttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303684 - DNA, 1869 bp, Homo sapiens
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaaggtgagccctggctggttgggggagcttcagcaggaaggtgaggggcctcgttgtttccagagcttcaccgattcctgtcactgcctgccctcagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303685 - DNA, 2312 bp, Homo sapiens
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaaggtgagccctggctggttgggggagcttcagcaggaaggtgaggggcctcgttgtttccagagcttcaccgattcctgtcactgcctgccctcagctgtcagacctggacagtgagactcgcagcatggtggaaaagatgatgtatgaccagcgacagaagtccatggggctgccaacttcagacgaacagaagaaacaggagattctgaagaagtgagcaattcagagacggggttgggggaccgtgggtgcctgggggcttagacttcggtgacagcagtgagtggatcactgcgctgcctcaggagctgccctgccccctttccagccatgtttatggctttatggctttggcttgcctactcttgtcatttgctgaggtcatcttgagggcaaggccggctcatggtgcatgataggagggaaggggtaacaggcggtcattgccacctacaggaaaacaatgccagtgttggtgcctcagcttccagcctcgggactcaaatgcgtctcagataccctgggccctgctcctgcccagcctggcttggtgttgctgaggtctaaagagattagacttgacacgggggtgctgggagaagggacagctttagaagagaaggatgagctgtttcatcttgcttccgtttctccaggttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303686 - DNA, 1764 bp, Homo sapiens
ggtatttcataccagggctagccttttgtatggttattagatgcgccggtgttcagctgtatgaactccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303687 - DNA, 1946 bp, Homo sapiens
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagattggcaggagagagaatgagtgccagcagaagaaatgccagacgctaataaaaccatcagatcttgtgagaactcactcgtatcatgagaacagcatgggggaaaccatcctggtgattcagttacctccacctggtactgcctttgacatgtgggaattacaattcaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303688 - DNA, 1869 bp, Homo sapiens
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacgtgagtgtcagggaccagaggtaaagcttagggggccagcctggggtaccagcagcacttagtggcctcttctgactgcctctgccctatgcagctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303689 - DNA, 1709 bp, Homo sapiens
ggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303690 - DNA, 1225 bp, Homo sapiens
tgcaggtactctagacgatcccgtttggcgtgaggccaaccctagcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303691 - DNA, 1087 bp, Homo sapiens
ggtggtgccggaatccgccgccgccgcctcccggaggtcctcctgatgccctaggaagacgcgactcagaattggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303692 - DNA, 1039 bp, Homo sapiens
tcccctcaacctctgatggggtcgctctacaagtaacgcttgcggtcgtgcgaggacctcgtggtgtccctttcgtacggcacggtcgtgactgggcatccccctcgcgatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303693 - DNA, 1513 bp, Homo sapiens
gtgtggtggtgcatgcctataatcccagttactcgggaggctgaggccggagaattgcttgaacccgggaggcagaggttgcagtgagccgagatggtgccacagcactccagcctggacaagaagaacaagactccatctcaaaaaatatatatatttattttcttcccattttaaatctggaatactgctttgtgtcttaagactcagcccgagtgtcactttcaaacttttctccctccaccctggatgaatatctccctttctgctttcttctttcccttatcacactgatttgtaactctttgcctctgtgtctcccctagctgcaggaagggcacagtcttgtacctctggatccagtgtaggcctgcaagggtctcaggtgcaggatgtggatgggagagagtttggttgtgaaagggttaaggggtgattcctggtgcacagagcaggccacctcccaccctctggttgttctcttcacagatcaataagatggagtggtggagccgcttggtgtccagtgaccctgagatcaacaccaagaagattaaccctgagaattccaaggtgagccctggctggttgggggagcttcagcaggaaggtgaggggcctcgttgtttccagagcttcaccgattcctgtcactgcctgccctcagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303694 - DNA, 777 bp, Homo sapiens
ctctatgtgcctgctctctatgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaata

SEQ ID NO: 303695 - DNA, 206 bp, Homo sapiens
ccatttgcctgaactttagttcagaaagactctttcaaatatctaagcaaacataatctagatagccaagaaatctattcatagaatggatgccaagcaatgttagagccaggcacggtgcctcatgcctgtaatcccagtgctttgggaggccaaggcaggtagatcagttgagttaaggagctcaggaccaccctgggcaacac

SEQ ID NO: 303696 - DNA, 4650 bp, Homo sapiens
gggaggcggtggccgaggcccaggcggtggcggcggcggcccaggaggcggcggacggggagctgcgggagcaggcccgggcctggctctctagcggccgcctggctgcagcatgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcctgcagtttgcattttatgtggttgaacaagttggtacccaaccctttaatcgagccatgcttttcaacgttggctttcaagaagcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtcccttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacgggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaa

SEQ ID NO: 303697 - DNA, 5061 bp, Homo sapiens
gggaggcggtggccgaggcccaggcggtggcggcggcggcccaggaggcggcggacggggagctgcgggagcaggcccgggcctggctctctagcggccgcctggctgcagcatgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcctgcagtttgcattttatgtggttgaacaagttggtacccaaccctttaatcgagccatgcttttcaacgttggctttcaagaagcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtcccttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacgggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaaaaaaaaaaaaaaaaaaaaaaaaaaaaatttggggggggcatgggccccggaaaaagttttcaaaacaatcgggtgagggggacgggggccccaaagggaagagggaacagggggcaaaagggggtcccaagggaaaccggggacaaaaacaaagggcgggggaattccccccaattaaaaaagccacggggaaacacgaagcgtttctgacaaactccaaagggaaccagagaagcacaaaaggggactcaaaacacagcagggaattccaaagggagacggaaataacaaaaaaaaaccgcgagagcgggggggggtgtacagacagaggaagagacgaacccagcaacaaacagaacagaacgcagaccacacccaggacacaagaagcaggacacagacacacgaaat

SEQ ID NO: 303698 - DNA, 4548 bp, Homo sapiens
gggaggcggtggccgaggcccaggcggtggcggcggcggcccaggaggcggcggacggggagctgcgggagcaggcccgggcctggctctctagcggccgcctggctgcagcatgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcctgcagtttgcattttatgtggttgaacaagttggtacccaaccctttaatcgagccatgcttttcaacgttggctttcaagaagcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtcccttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacgggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgattgctgtgtgcagggaaaggtgtccccgtttgttcatgctgttttggggggtgggggggtatttgcaagaatactcattttgacataataggtcctcttgtcagagatcctctacccccca

SEQ ID NO: 303699 - DNA, 3423 bp, Homo sapiens
gcagctgtgggcgacagacacagggcctgcgagtccagacgggtagatccaggcaagttgcacgcggacgggtccggccccttcagtgtgcaaagtaaggaaatcaagcaggcggggagcaacacaagacggggtggcgcgccgtcattcaggaaggtttcccgacccgaccgaccgtcgagcgggagcctgaccggcaagccacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtcccttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacgggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaa

SEQ ID NO: 303700 - DNA, 1987 bp, Homo sapiens
aaaaaagcagaacatgataatagatattagttagtaagtaagcatatagtatgttattaaatagagacagagtctcgatcagattaccaggctggagtgcagtggtgccgtctccgctcactgcaacctctgcctcccaggttcaagtgattctcctgcctcagcctcccgagtagctgggattataggcatctgccaccacgcctggctaatttttgtatttttagtagagatgggaattcaccatgttggccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaa

SEQ ID NO: 303701 - DNA, 4056 bp, Homo sapiens
gggaggcggtggccgaggcccaggcggtggcggcggcggcccaggaggcggcggacggggagctgcgggagcaggcccgggcctggctctctagcggccgcctggctgcagcatgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcctgcagtttgcattttatgtggttgaacaagttggtacccaaccctttaatcgagccatgcttttcaacgttggctttcaagaagcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtcccttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacgggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgagcagcgaaaaaatcccttttactgtacactctcaaagcaagaaagagaaacaacagttttgttttgtttttttct

SEQ ID NO: 303702 - DNA, 3764 bp, Homo sapiens
gggaggcggtggccgaggcccaggcggtggcggcggcggcccaggaggcggcggacggggagctgcgggagcaggcccgggcctggctctctagcggccgcctggctgcagcatgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcctgcagtttgcattttatgtggttgaacaagttggtacccaaccctttaatcgagccatgcttttcaacgttggctttcaagaagcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtcccttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacgggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaa

SEQ ID NO: 303703 - DNA, 3455 bp, Homo sapiens
gggaggcggtggccgaggcccaggcggtggcggcggcggcccaggaggcggcggacggggagctgcgggagcaggcccgggcctggctctctagcggccgcctggctgcagcatgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcctgcagtttgcattttatgtggttgaacaagttggtacccaaccctttaatcgagccatgcttttcaacgttggctttcaagaagcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtcccttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacgggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggagcggcccttgctgcgcatcgtgcgcgagcattgaaataatgtcctgtgtgaaaaatttgaacgcgccgcgtgaaaaatcaatctggact

SEQ ID NO: 303704 - DNA, 829 bp, Homo sapiens
cttgatggtaattaccatcaagtacacactgttagccttttgccaacagtgtgtacttgatggtaatgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaa

SEQ ID NO: 303705 - DNA, 114 bp, Homo sapiens
gtatatttttagtaaagaggtggtctgattagaatgtctcctcccaagagaggtaaattcggttgcaataattattttcaatgggaaaagcgcattgtaaaagagggatttggc

SEQ ID NO: 303706 - DNA, 419 bp, Homo sapiens
acctcagcctcccaagtagctgggattacaggcatgcgccactacgcctagctaatgtttttgtattttcagtagggatggggtttcaccatgttggccaggctggtctcgaactcctgatccgcccaccttggttttccaaagtgctgggattacaggcgtgagccactgtgcccatgccagaggtccagtgacttctgagccacactgtgagttgatttgtggtgttggacctggttacactagcccagtgatcttttccagttggttctaataaactcgtctttaggcacaggaaagacagcaaagattttccttcaagattcttttaaagataaagttctgtttcttttaggttggtacccaaccctttaatcgagccatgcttttcaacgttggctttcaagaagcaatgaaag

SEQ ID NO: 303707 - DNA, 4301 bp, Homo sapiens
cgacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcagccctatgcaggtatgcaagcctacgcttatccccaggcatctgccgtcacctcccagctgcagcccgttcggcctttgtacccagcaccgctctctcagcctccccatttccaaggatcaggtgatatggcttcatttctcatgactgaagcccggcaacataacactgaaattcgaatggcagtcagcaaagtggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgagccacagggtgaggtcaaggtgagcattctgggaacaatatttgggctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttgatccaag

SEQ ID NO: 303708 - DNA, 466 bp, Homo sapiens
tcctgactttttcatctactgtctttcttctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttgatccaag

SEQ ID NO: 303709 - DNA, 3122 bp, Homo sapiens
cagacagtcagcctcagtcttcaatgagggaccccgtacagagtaacccaaacgcttgttcctgtttcaggatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcagccctatgcaggtatgcaagcctacgcttatccccaggcatctgccgtcacctcccagctgcagcccgttcggcctttgtacccagcaccgctctctcagcctccccatttccaaggatcaggtgatatggcttcatttctcatgactgaagcccggcaacataacactgaaattcgaatggcagtcagcaaagtggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgagccacagggtgaggtcaaggtgagcattctgggaacaatatttgggctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttgatccaag

SEQ ID NO: 303710 - DNA, 2771 bp, Homo sapiens
actgcaatctgtgcctctaatactggtgatgctagaggtgatgtttttggtaaacaggcggggtaagatttgccgagttccttttactttttttaacctttccttatgagcatgcctgtgttgggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgagccacagggtgaggtcaaggtgagcattctgggaacaatatttgggctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttgatccaag

SEQ ID NO: 303711 - DNA, 2498 bp, Homo sapiens
caacgatggtcctcagctataggagagatggtccaccccataatttgaatttggtttaatgcaggttgaaggcagccataactccctgtttactagttcagtctacatagagttatgtgaggttggttcatcacctgcatggagaacacctatgtttaaagtgacatcatactttgttattattcaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgagccacagggtgaggtcaaggtgagcattctgggaacaatatttgggctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcctgggacatgtatcttcttctttgccttaaatctgatacaagaggtcaatgactttgaaaataaaactaaaataaatgtctataatgaaacttgatccaag

SEQ ID NO: 303712 - DNA, 4261 bp, Homo sapiens
cgacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcagccctatgcaggtatgcaagcctacgcttatccccaggcatctgccgtcacctcccagctgcagcccgttcggcctttgtacccagcaccgctctctcagcctccccatttccaaggatcaggtgatatggcttcatttctcatgactgaagcccggcaacataacactgaaattcgaatggcagtcagcaaagtggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgagccacagggtgaggtcaaggtgagcattctgggaacaatatttgggctcagagggtgggttggccaccttctgagccccacccccgccagacctggtgaagaggatcataaccctgtcttcaagaacactgggatttcagcagcaagttggaagaaggactggtaggttcccctccaagccagtcacctgtaagagtcctgtcctctgccagactttttaatctcttcattaactctcagactgacctgggagccctcctctacctgaatccagtgctcaactgtgccccggcaacaagacctgggctgaggtctccctggtagaactaagggagattacaccatctaaatcccagtgcagtcaacagcctggcctatagtcattgacctcttgtaccagatttaaggcaccgaagaagatacatgtcccaggactataggtc

SEQ ID NO: 303713 - DNA, 3813 bp, Homo sapiens
cgacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcagccctatgcaggtatgcaagcctacgcttatccccaggcatctgccgtcacctcccagctgcagcccgttcggcctttgtacccagcaccgctctctcagcctccccatttccaaggatcaggtgatatggcttcatttctcatgactgaagcccggcaacataacactgaaattcgaatggcagtcagcaaagtggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaagtgtttagccctccaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagatggtgactcttcagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcgacagttgtgatcgtggtgtgcgtcagcttcctggtgttcatgattatcctgggggtatttcggatccgggccgcacatcggcggaccagtgcgggatcaggacaccgggaaggagaacgagatggaactgggacgactcggccatgaccatctccgtgaacatccatggaggtacggaga

SEQ ID NO: 303714 - DNA, 2725 bp, Homo sapiens
cgacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacctcttccctggatgcagtgctctcccaggacctcattgtggcagacggccctgctgtagaagttggagattctttggaagtggcctataccggctggctctttcagaatcatgtgctgggccaggttttcgactccactgctaacaaagataagttgcttcgcttgaagttaggatcaggaaaagtcatcaagggctgggaggatggaatgctgggcatgaaaaaaggaggaaagcgattgcttattgtccctccagcctgtgctgttggctcagaaggggtaataggctggactcaagcaacggactcgatcctggtgttcgaggtggaggttaggcgggtgaagtttgccagagattctggctctgatggtcacagtgttagttcccgcgattctgcagctccgtctcccatccctggtgctgacaacctctctgctgatcctgttgtgtcaccacccacatcaatacctttcaaatcaggggagccagctcttcgtaccaaatctaactccctcagtgaacaacttgcaataaatacaagtcccgatgcagtcaaagccaagttgatctctcggatggctaaaatgggccagcccatgctgcccatccttccaccacagctggattccaatgattcagaaatcgaagatgtgaacactctgcaaggaggtgggcagcctgtggtgactccgtccgtccagccctctcttcatccggcccatccagcgttaccacagatgacctcacaggcacctcagccatctgttactgggctccaggcaccttctgctgccttaatgcaagtgtcatctctcgattcccactcagctgtatctggaaatgcccaatcctttcagccctatgcaggtatgcaagcctacgcttatccccaggcatctgccgtcacctcccagctgcagcccgttcggcctttgtacccagcaccgctctctcagcctccccatttccaaggatcaggtgatatggcttcatttctcatgactgaagcccggcaacataacactgaaattcgaatggcagtcagcaaagtggctgataaaatggatcatctcatgactaaggttgaagagttacagaaacatagtgctggcaattccatgcttattcctagcatgtcagttacaatggaaacaagcatgattatgagcaacatccagcgaatcattcaggaaaatgaaagattgaagcaagagatccttgaaaagagcaatcggatagaagaacagaatgacaagattagtgaactaattgaacgaaatcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgccagttcctgcttcttgaaagaaatgttgcaatcaagaagctaagccgaccatttcagaatcagactcatgccaagcgggcctacagagagctagttcttatgaaatgtgttaatcacaaaaatataattggccttttgaatgtttcacaccactgaatccctagaagatttcaagagcagacggg

SEQ ID NO: 303715 - DNA, 605 bp, Homo sapiens
cgacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagaggtgagagtgctcccacatctcatgtatattcagatgtcccaaataataccaatgagctggcttttatctggcttgcctgatgtcttgtttatcagaagataaggatgattgtttgtattgaatgttaatttataacatcaagcatatagtaaatgatcacattttgcttactattgtgcattaaaacaaatccaaccattaaaaa

SEQ ID NO: 303716 - DNA, 705 bp, Homo sapiens
cgacgtcggcggtgacaggccctgggactctgggaatacccagcttcctccccgcaacccggtgaaagccaacgcaatgttcggtgcgggggacgaggacgacaccgatttcctctcgccgagcggcggtgccagattggcctcactttttggactggatcaggcagctgctggccatggaaatgaatttttccagtacacagccccaaaacagcctaagaaaggccagggaacggcagcaacaggaaatcaggcaacaccaaaaacagcaccagccaccatgagcactcccacaatactggtcgcaacagcagtccatgcatatcgatacacaaatggtcaatatgtaaagcagggcaaatttggtgctgcagttctggggaaccacacagccagagagtataggattcttctttatatcagtcaacaacagccagttacggttgctaggattcatgtgaactttgagctaatggttcggcccaataactatagcaccttttatgatgaccagagacagaactggtccatcatgtttgagtcggaaaaggctgctgtggagttcaataagcaggtgtgcattgctaagtgcaacagtacgaggcctgtctctggccctgagctttgtggcctgccgtaggaactggagcttcattttcaaagctccatactcgccttctccccaacgctatctcttaccggtcg

SEQ ID NO: 303717 - DNA, 202 bp, Homo sapiens
caccttctgctgccttaatgcaagtgtcatctctcgattcccactcagctgtatctggaaatgcccaatcctttcaggtaacattttataaccgtattaattatatcctataatttgctgtggttctagtcagtctcttttcttcttcctgtacatttcatacagtagcagttccccaaagtcagagtttgtaatttttttc

SEQ ID NO: 303718 - DNA, 367 bp, Homo sapiens
atctttactagcattcaaagattatgcaaactaaagaagagttaaaattctgttttacagtcattaaattggcacacatttaaaaaaacaatttgcttatccaatataatttggacttgtgattctggattttgttttcaatcttggaatatggtctatttgctttcagggagccagctcttcgtaccaaatctaactccctcagtgaacaacttgcaataaatacagtaagtataagagtcttggccaggcatggtggttcacacctgtaatcctaacactttgcgaagctgaggcaggaggatcactacagtgcaggagttcaagaccagcctaggcaacatagtgagacctcgtctctccttta

SEQ ID NO: 303719 - DNA, 451 bp, Homo sapiens
aagagccactggggccaggcgcaggggctcacgcctgtaatcctagcactctgggaggctgaggcaggaggactgcttgagcccaggagatggaggctatagtgagctatgatcacaccactgcactccagcctgagtgatggagcaaggctttgtctccaaaaaataatttaaaaaaagagctgctgggataacacatagcccattacagctttggttctgtagcgaagtctctctgctcctgtatcccagagctccaagaaacctctgagcaagcacagtccaaattcaaaagtgaaaagcagaaccggaaacaactggaactcaaggtgacatccctggaggaggaactgactgaccttcgagttgagaaggagtccttggaaaaggtaagctctacaacccagttggccagaattagctgtttaataaacatttttattttcctttt

SEQ ID NO: 303720 - DNA, 377 bp, Homo sapiens
agaatttgaaataaaattgtctttttattatatgcaaaaaaaaaaaaaagagacttgatgtttgggtggttctcctccccttgggttttctgaccttcacctggttcctgaggccacagccacagtctgtttgttttgcagtgtttagccctccaggcccaaatcacagctctcaccaagcaaaatgaacagcacatcaaggaactagagaagaacaagtcccagatgtctggggttgaagctgctgcatctgacccctcagagaaggtgagctggtatttcaaatgagaagcaagccatttatatcaagcattcagaaagaacatggccagtatgttgtgttaatagctctttttctaactttagtgatgttttac

SEQ ID NO: 303721 - DNA, 358 bp, Homo sapiens
  misc_feature (342)..(342): n is a, c, g, or t
ctgccctcatcatagcagtggaacaggaccagctgggacagggtccttctgtgacacctgctgtgtcaccaggctgtgcgaatggactcagctgccagaactcacagaatatcagtaacagcaccgaaacttcacaggaaaaatgctccacgaacttcagacttaaaaagcatcactggctcctgaccaggattccagctccatgaacctcaaactagaacaccagcccggcttctctgcaggtctccagctccaaaacctaagacatcagtggcagtacaaactcatcccaggggaggctgcagtgagccatgatcatgccattgcactccagcctgagtngcagagtgagattctg

SEQ ID NO: 303722 - DNA, 639 bp, Homo sapiens
ctgccctcatcatagcagtggaacaggaccagctgggacagggtccttctgtgacacctgctgtgtcaccaggctgtgcgaatggactcagctgccagaactcacagaatatcagtaacagcaccgaaacttcacaggaaaaatgctccacgaacttcagacttaaaaagcatcactggctcctgaccaggattccagctccatgaacctcaaactagaacaccagcccggcttctctgcaggtctccagctccaaaacctaagacatcagtggcagtacaaactcatcccaggggctccagctccaggaccctcagacttgaaccgcagcaccaactcttccctggatctccatctccatgaccctcagacttaaacagcagcagcaccagttcatctgtgaatctccagctccacaaccctccaactagaaacacaccagctcctccctgggtctccagctgcacgaccctcaaactacaacatcagctcctccccgggtctctaactccatgaccctcaaactaaaacaacactgctcacccctgggactccagatccacaaaccttacactagaacagaaacaccagctcctccacagatctccagctttacaatctaagacattagtggcagca

SEQ ID NO: 303723 - DNA, 493 bp, Homo sapiens
  misc_feature (3)..(3): n is a, c, g, or t
  misc_feature (33)..(33): n is a, c, g, or t
aanacatggcttgtgcccatcataaaaaaagantcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataac

SEQ ID NO: 303724 - DNA, 1372 bp, Homo sapiens
cgtggaggccgccagtcgcggcgatcttctcctcgcttctggagtgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggattgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtatgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttg

SEQ ID NO: 303725 - DNA, 1895 bp, Homo sapiens
aaagcttccagaatgtaaggtttagttcgactgcatacctcattacctccccttccctcctccctccccttactcccaggaagtttgcagggtaaataaaacatgcacatgataataaaacaaagtggaatgtactaaaataccaaaaggaaaatacagattaggtatactgagtaaatatgttacagagaaaacttcctgtatttaaaaagtaaggaacaatgggatgagatcatagataatcctggagcatttcctggtagtaaatttccagccaggtttatatcccaggtctggggattggaggttaagtttctgcatatacaatatttgtttacattcctctctgcctctaccagacagacagacagacacacacacacacacacacacacaccctctgtctctttctctctctttctctctctctctctctctctctctctctctcacttgagtgacagatgctggtgcagggtattctcaacaggagtagggaatttgaaataaggagttgagaggtcaaaggtaaggggctgaatgcaggaccagagagcttcagtagcatcttgatgggcagagtatgagatgaacagtggcaacgaggaggatagggaaaaatcacattttctgtttgtgttttgtttttgtctggtggttttcaacctctctctgtttcacttgactatgcttgattatgaaatcttttttttttctttttttaatttaaagatctcaactggctttgttgtgattctacattcaggcaacactattctgtaaaatagtataaatgttccgatgagttgaacagaggagattggctttgtagacagaaaagggctgaagaaaacagaaataaaaaaatcttttccttttcatagtgagagctcagatgcaaatgtatggagtggggatggatgggaaatgccgtcttttgcaaacccttggaaacgctgtcaccctgtgggtctcacagccagtgtacagataacaccctcatctgtacacagaagacagaaggtggcaggggaaggaatgagcacaccccagaatgagtagcaagtttaatcaataaaatatgtatttctttttttattgttgtataagaagaaaagcagacagaactcaaaccctgaagctgattttgcaagtgaaaagcttagtaaagggggaaatgttatgtaactattttttcagtttagtgtggatggcttaagaaataatcattactgtgaggacactagtatttttcttggaaaaaaaagtttggcaaattttcctctttagattaatcttggttatagattattattatgcttgagtggtacctcttcagaagtagaaatctggcaaaaactggagtacaatgattgctctaggaataaattcacatatttaaatttaaaagcctggatatgtgcatggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtatgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttg

SEQ ID NO: 303726 - DNA, 4983 bp, Homo sapiens
cgtggaggccgccagtcgcggcgatcttctcctcgcttctggagtgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgaccagggccgcagaagacgcatgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgccacggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcatgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtatgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttgaactctgaaaatgtacatgtatggctggacgcggtggctcacgcctgtaatcccagcactttgggaggctgaggcgggtgaatcacttgattgaggtcaggagttcgagaccagcctggccaacatggcaaaaccccgtctctactaaaaaatacagaaattagctgggtgtggtggcagacagctgtaatctcagctgctcgggaggctgaggcacaagaatcgcttgagccagggaggtggaggttgcagtgagctgagatcacatcattgcactccagcctgggcaacgggcgagactctgtctcaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagatgctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcatgcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttcaaaaaaaaaaaa

SEQ ID NO: 303727 - DNA, 4522 bp, Homo sapiens
tgaagatatcaggacatctggacaaggacatgctttcctggcttgcatgtggcagccctgtcctgactgcttttgtttccacaggaactgagacattggagtgctttggcccagagatgagggcagcatgtgacccacctgccccttgtctggcttactggctgccgtctttgcagtgggcagttgctcagttttgccatgaccggagggtctaaagatccttttccccttctctttagacttcatcctgtgaagccaatgaatgccacggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcatgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtatgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttgaactctgaaaatgtacatgtatggctggacgcggtggctcacgcctgtaatcccagcactttgggaggctgaggcgggtgaatcacttgattgaggtcaggagttcgagaccagcctggccaacatggcaaaaccccgtctctactaaaaaatacagaaattagctgggtgtggtggcagacagctgtaatctcagctgctcgggaggctgaggcacaagaatcgcttgagccagggaggtggaggttgcagtgagctgagatcacatcattgcactccagcctgggcaacgggcgagactctgtctcaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagatgctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcatgcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttcaaaaaaaaaaaa

SEQ ID NO: 303728 - DNA, 1602 bp, Homo sapiens
gattatttatattctatagtcctgacctatgtcaggcactgtggatcacctgtgtggttacaatgggggtacactgttgtgccaccgggttttacatgtggagtaaccatggttttcagtgagcccagattgcgcccatgtcacttcagcctgggccacagagccaaaactttattccataaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagatgctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcatgcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttcaaaaaaaaaaaa

SEQ ID NO: 303729 - DNA, 4232 bp, Homo sapiens
cgtggaggccgccagtcgcggcgatcttctcctcgcttctggagtgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgaccagggccgcagaagacgcagtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgccacggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcatgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtatgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttg

SEQ ID NO: 303730 - DNA, 232 bp, Homo sapiens
aaagaaagaaagaaagaaagaaaatggattcccaagagacccagatcactagtcactttttcctcctttgtacttcttttaggttttaggtttctgtgctaattttataactcctttttcccaactatttccccccctccaaagaaatacagcccctcggaccctgcatttgcatatgcgcagctgacccacgatgagctgattcagctggtcctcaaacagaaggaaacga

SEQ ID NO: 303731 - DNA, 315 bp, Homo sapiens
aaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccggtgagttttggctcttctagtgcagggcatttctgccttgccat

SEQ ID NO: 303732 - DNA, 5961 bp, Homo sapiens
cgtggaggccgccagtcgcggcgatcttctcctcgcttctggagtgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgaccagggccgcagaagacgcagtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgccacggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcatgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtatgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttgaactctgaaaatgtacatgtatggctggacgcggtggctcacgcctgtaatcccagcactttgggaggctgaggcgggtgaatcacttgattgaggtcaggagttcgagaccagcctggccaacatggcaaaaccccgtctctactaaaaaatacagaaattagctgggtgtggtggcagacagctgtaatctcagctgctcgggaggctgaggcacaagaatcgcttgagccagggaggtggaggttgcagtgagctgagatcacatcattgcactccagcctgggcaacgggcgagactctgtctcaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagatgctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcatgcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttcaaaaaaaaaaaa

SEQ ID NO: 303733 - DNA, 5907 bp, Homo sapiens
cgtggaggccgccagtcgcggcgatcttctcctcgcttctggagtgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgaccagggccgcagaagacgcagtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgccacggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcatgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtatgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttgaactctgaaaatgtacatgtatggctggacgcggtggctcacgcctgtaatcccagcactttgggaggctgaggcgggtgaatcacttgattgaggtcaggagttcgagaccagcctggccaacatggcaaaaccccgtctctactaaaaaatacagaaattagctgggtgtggtggcagacagctgtaatctcagctgctcgggaggctgaggcacaagaatcgcttgagccagggaggtggaggttgcagtgagctgagatcacatcattgcactccagcctgggcaacgggcgagactctgtctcaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagatgctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcatgcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttcaaaaaaaaaaaa

SEQ ID NO: 303734 - DNA, 2046 bp, Homo sapiens
cgtggaggccgccagtcgcggcgatcttctcctcgcttctggagtgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgaccagggccgcagaagacgcagtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgccacggccaccaaggttgctaactgcagcttgggaactgccaccatcatcagtgagaacttgaacaatgaggtcatgatgaaggtatgtcctctgagaagctggtgtgttcgttagggattgacagaacacccgtttccatagtcaccatcgtatacctctccctgggcagccggtggtgcaggaacacttagtcatacatcttgagtctttgagtaaactttggaagcccccagacattccattggataattactttattcccttatacttgtttagttatggtaaatttttttttttgtctcaagcaacatagagagatcccgtctctatggggaaaaaa

SEQ ID NO: 303735 - DNA, 397 bp, Homo sapiens
ttcccgaagagaaagcatgagaatgcatgcattgaagaggctgctggtagcagagaggagaggccagttcatggggattgtgaacattgttgcagttgcttccattcaaaggtaactcctcagcctttctcctttcaggtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagac

SEQ ID NO: 303736 - DNA, 984 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcc

SEQ ID NO: 303737 - DNA, 1051 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaacaaccaaaccctaccaaagtcacacaccaaacagtaccgcagcctgcaaaagaggggcggcgc

SEQ ID NO: 303738 - DNA, 1064 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggctcaataagttgggttatgccaaaaaaaacaaaagacaaaacaaaaaggggcgcggaaagatacccgagggcaagacaccgctccccggtcggacaggggcccag

SEQ ID NO: 303739 - DNA, 1089 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcccaaaaaaaaaacaaaaaacaacccggttcttgggcggaaagaatcaagggctgtctctgtccccccctttcaaggaaaccgcgccacagggtttcagcaacacac

SEQ ID NO: 303740 - DNA, 1018 bp, Homo sapiens
  misc_feature (5)..(6): n is a, c, g, or t
  misc_feature (22)..(22): n is a, c, g, or t
aaatnnggctaggtacgaggcngggtgttgaatcggccgaggcaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataagttggtgtttatgccagaaagaaaaaaaaaaaaaaaaaccgggggacacatcaatgggggggggaaaaagggtaaaaaaggcgccacgtgcaaaggggtccggcaccccttttttgtcacacaggggagaatcggagcgccccaaaaggggcgaaaatcaaagccggacc

SEQ ID NO: 303741 - DNA, 1006 bp, Homo sapiens
  misc_feature (865)..(865): n is a, c, g, or t
accacgcgtcgcggacgcgtgggtcgacccacgcgtccggaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcggagaagagaactagtgctgagggcctcataaagttgggttatgcccaaaanaaaaacatacaacacaacaaaaaacggggggcgcaaaaacacaagggccaccagcccctctcttagggccaaggggacataacaggcggggaacagcggaccgggtgttgcaccaccggggggacccgacgcacaaacagg

SEQ ID NO: 303742 - DNA, 926 bp, Homo sapiens
gtgcagggccggagaccttaggctaggtacgaggcctgggtgttgcgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatcctttggaggtggcaaccaccagcacatcggcaagcctccacatcggagagatgccctgttggcgaaagtgggtctcattgctgccgcggactggacgtctccgggaaccaagactgtgcggaagagacactgtggggcacaagtggtttgcaaaaccacaaccccccccaccacccaacaaccccctcttccgcgcacaa

SEQ ID NO: 303743 - DNA, 739 bp, Homo sapiens
  misc_feature (13)..(13): n is a, c, g, or t
  misc_feature (17)..(17): n is a, c, g, or t
  misc_feature (719)..(719): n is a, c, g, or t
gcctggtgtgaancggncgcaggcctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcaccacgacccgggccgcggcgcgcccctcgccaaggtggtcttccgggatccgtatcggtttaagaagcggacggagctgttcattgccgccgagggcattcacacgggcagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcacaccaaattacggggggttgttggcccatgaaatccctgttggaaccatccctttttcgggaaaggttgggcaaacccaaccaagcaacattccgggccaaanccccttcccaaccaattccc

SEQ ID NO: 303744 - DNA, 711 bp, Homo sapiens
  misc_feature (28)..(28): n is a, c, g, or t
acttacggctaggtacgaggctgggtgncgcacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaacaaaaaaaaaaaaaaaaaacacaaacaagaaaaaaaaacacccgcagcggaggcactactcgaaccggtgtgcgccgaaagaaaaaaaacggggctgcgattaaataacgatgcgcccgcgggttgctacaagaggttatctccgttgagacccccatccttttttctaccagacgagggggcaaaaaacctgggggcgaccccccactataagagggggacgcataaaatcaccccgataacacagggtgcaccccggcataa

SEQ ID NO: 303745 - DNA, 941 bp, Homo sapiens
  misc_feature (31)..(32): n is a, c, g, or t
  misc_feature (39)..(39): n is a, c, g, or t
agcgggaaaaactgtaggctagtacgaggcnnggtgttncaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggctcaataagttgggttatgccaaaaaaaacaaaagacaaaacaaaaaggggcgcggaaagatacccgagggcaagacaccgctccccggtcggacaggggcccag

SEQ ID NO: 303746 - DNA, 742 bp, Homo sapiens
  misc_feature (486)..(486): n is a, c, g, or t
  misc_feature (569)..(569): n is a, c, g, or t
  misc_feature (581)..(582): n is a, c, g, or t
agcggctttggccgcgctggtgaaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctcnggggaaaccaagactgtgcaggagaaagagaactagtgctgagggcctcaataaagttgtgtttatgccaaccgaaaaaaaanaacaaacacacnnaaaaacaaaactgttttgggggccccctgggcctcagaaaaagttttttaaaaccattcggtttggggcggggggcccatgggttcagtgacctgtgctcacgcggtgtcccaggagacacccgggccgaaaacggctgggttttctcccaattaaaagc

SEQ ID NO: 303747 - DNA, 1019 bp, Homo sapiens
  misc_feature (856)..(856): n is a, c, g, or t
  misc_feature (861)..(862): n is a, c, g, or t
  misc_feature (865)..(865): n is a, c, g, or t
tctctctctctctctctctctctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaaggtttgtgtttatgccaaanaaaannaanaaaaactccggggcactcaatcggggtgcggaaacagcgcgctctgagatgggccaatggtgtccataccgtgttccggacccccttttcttggcacacggcggtaacttcccggccccctataagggggccaataaattccgaagcgggtacg

SEQ ID NO: 303748 - DNA, 890 bp, Homo sapiens
cgcgaacaggtttacacagcgagcaactaattccgtcgaccacgcgtctacgttatctcccacaaaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaggaaaaaaatacacaaataaatagaaaaagaaaaaaaaggggggcggcgcgcgcgcgcacctaaaaagatcttccccgggagggggcccgaaaggtatgtcggcgatccagccagcggtttggtgtgcgcagcaagcgggggcgcccccaaatgaagggggcggtcgctatatatataagaacgcaatacggcgacccgcgcggcggcggggtataacaaaccagcggacgaggacgaggcggaggaaacccagcgcggcgaccacgcgggcagacccctagtggggagagagagagcgccccctcaaactactccgggggcggggcgagcacaaatagtggggggcagcacaacccctccctcacaagaaggaattagtaacccgccccacgaagggacggaacaactagt

SEQ ID NO: 303749 - DNA, 1059 bp, Homo sapiens
  misc_feature (13)..(13): n is a, c, g, or t
  misc_feature (17)..(17): n is a, c, g, or t
gcctggtgtgaancggncgcaggcctctttcggccgcgctggtgaacagcaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcaaagaagcggacggagctgttcattgccgccgagggcattcacacgggccagtttgtgtattgcggcaagatgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaaagagaactagtgctgagggcctcaataaaggctttggtgttttatgccccaaaaaaaaaaaatctaaactcaacccagctgaatcgacgagaacggaacgacaccgctgagtactcacgaaaccactcaaccaacacgaaaaaaagggggcgggggccataatattccccgggagggacaatatcgtcgcaccctttttttgaaaggcgccagtggatgtctaataagacgggcggcgcgctaaaaaggtaggcaggaacagggctggttattggagaaccctggggtgagatggccccccgaagtgccgggaaaatagtgtgggaccagct

SEQ ID NO: 303750 - DNA, 534 bp, Homo sapiens
  misc_feature (20)..(20): n is a, c, g, or t
  misc_feature (71)..(71): n is a, c, g, or t
cacgcgtcggacccacgcgntcgcccacgcgtccggacccacgctgtcgcccacgcgtccgcggacgcgtnggcgctggtgaacctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcc

SEQ ID NO: 303751 - DNA, 1148 bp, Homo sapiens
agcggctttggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaacgttgtgttatgccaccttgaaacactaaaaaaaaagacaagcgagaacaacacacaacaagaaaaacaaagtaaagaagacatagagaggacagcaccagaaccagagatataaccaggatgagcgggcgcggagctgagctacaaatttgtatccctcagtgaagcgaccacaattattcgcgagcacaccaaagtatttatatgaacaaataaagtaccccctcgatagctcaagtcaaatacaagcaacaagcgccgcgcgcccgtgataagaagccgtgcggcttcgaaaagaattcgtttcatggcgtacattaggagcaaccccaccatctggggggcgccagacagctggaccacaccaccgagaattagcctcctagg

SEQ ID NO: 303752 - DNA, 1437 bp, Homo sapiens
  misc_feature (1318)..(1318): n is a, c, g, or t
ggcacgaggtagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcccaataaagttgtgttttgccacaaaaanaaggggggcgcaaaaatcccagggccagtagggtaccacttgtcaagggccaagagcggtataaagaccgggggtaaaaggcggacagacgggtgaagacctggggacagaaaagagac

SEQ ID NO: 303753 - DNA, 965 bp, Homo sapiens
  misc_feature (20)..(20): n is a, c, g, or t
  misc_feature (71)..(71): n is a, c, g, or t
  misc_feature (872)..(872): n is a, c, g, or t
cacgcgtcggacccacgcgntcgcccacgcgtccggacccacgctgtcgcccacgcgtccgcggacgcgtnggcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcggagaaagaaactagggntgaggccctcaataaagttggggttttgccctataataatcttcttttccttatttctataagtcttcatttctctagtatctagtgatttat

SEQ ID NO: 303754 - DNA, 614 bp, Homo sapiens
  misc_feature (544)..(545): n is a, c, g, or t
  misc_feature (569)..(569): n is a, c, g, or t
  misc_feature (580)..(580): n is a, c, g, or t
  misc_feature (594)..(594): n is a, c, g, or t
  misc_feature (597)..(597): n is a, c, g, or t
accacgcgtcgcggacgcgtgggtcgacccacgcgtccggaaaagaagcggacggagctgttcattgccgccgagggcattcacacgggccagtttgtgtattgcggcaagatgctccctgtgggcaccatgcctgacctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggaganngagaactagtgctgagggcctcantaaagtcggtnatgccaaaaaaaanaangaaaaaaacaaaggggg

SEQ ID NO: 303755 - DNA, 774 bp, Homo sapiens
cggacgcgtgggtcgacccacgcgtccgggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagacagctcaacattggcaatgtgctccctgtgggcaccatgcctgacctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaaaaacgtgcggaggcccagattgggaattcc

SEQ ID NO: 303756 - DNA, 859 bp, Homo sapiens
accacgcgtcgcggacgcgtgggtcgacccacgcgtccggaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcggagaagagaactagtgctgagggcctcataaagttgggttatgcc

SEQ ID NO: 303757 - DNA, 803 bp, Homo sapiens
  misc_feature (297)..(297): n is a, c, g, or t
gtgaagaggaccgtcgtcatggcgaactgagtgatctgatgtactaagatgaatgacccgtagtctgtagtgctcgcgccgttcagcccgtaaatacgctgtccgcctacgcgccgagaatttctatgattactactgctacgtcaagggtatcgtctcatgacgtcatctcacaggaactagggccggcgcgcagcccctcgtatagcggtgggtctcccgcgatatccagaatcggttcaaaagtagatggagctgtcattgccgcgagggcattcacagggccagttgtgtatntgcggctaagaaggcccagctcaactattggcaatgttgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccgggaaccagactgatgacgctagaggtaccg

SEQ ID NO: 303758 - DNA, 693 bp, Homo sapiens
  misc_feature (27)..(27): n is a, c, g, or t
  misc_feature (29)..(29): n is a, c, g, or t
aggctggtgttaattcggccgagggtnancaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcaccacgacccgggccgcggcgcgcccctcgccaaggtggtcttccgggatccgtatcggtttaagaagcggacggagctgttcattgccgccgagggcattcacacgggccagtttgtgtattgcggcaagatgctccctgtgggcaccatgcctgagggtacaatcgtgtgctgcctggaggagaagcctggagaccgtggcaagctggcccgggcactccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacacggcaagccctccaccatccgcagagatgcccctgctggccgcaaagtgggtctcattgctgcccgccggactggacgtgcggactgacgtctcggggaccagatg

SEQ ID NO: 303759 - DNA, 747 bp, Homo sapiens
  misc_feature (636)..(636): n is a, c, g, or t
attcccggatcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcaccacgacccgggccgcggcgcgcccctcgccaaggtggtcttccgggatccgtatcggtttaagaagcggacggagctgttcattgccgccgagggcattcacacgggccagtttgtgtattgcggcaagatgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcacacgagtacggggtgtggccatgaatcctgtggagcatccttttggaggtggcaaccaccagcacatcngcaagccctccaccggattcatggccacaccccgtaccacaaatttaggcaaagaggaactgctggcaacgagtacggggtgtggccatgaatcctgtggagcatcctttt

SEQ ID NO: 303760 - DNA, 1343 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaacaaaaaaaaaaaaaaaaaaaaaaaaaaaaaaaaaaaaaaaaaaaaaaaaaaaaaaaaaaaaaaaaaaaaaaaaaaggggggggggggtatgaaaaaattttcggggaagcggcgcaacaataaatgagcgtcacaaattttatgtaaataagaggggcacctgattgagggatcatataaataaaagagggagggggggattaacaaagagcgggaggcaaaaacagggttgtaatataggaagaccacactcatgtgggggaaatagggacacacacgaaaatagggggggaaaaaaagaggtatgggaaacaggtatcaggggagaatgttagctgtagaatagg

SEQ ID NO: 303761 - DNA, 1175 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaacaaaaaaaaaaaaaaaaaaaaaaaaaaaaaaaaaaaaaaaaaaaaaaaaaaaaaaaaaaaaaaaaccttgtgggccgcttgggccaagtgaattttagactggagcaagttaatgcatgcggccgaatttggagctaattgggccaattggccttatagggagccgttttacttccggc

SEQ ID NO: 303762 - DNA, 1060 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaacacacaaaacacaaaaaaaacatccttttggaagaaaaagcggacctccccttggagcgccaagaa

SEQ ID NO: 303763 - DNA, 1138 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataagttggtgtttatgccagaaagaaaaaaaaaaaaaaaaaccgggggacacatcaatgggggggggaaaaagggtaaaaaaggcgccacgtgcaaaggggtccggcaccccttttttgtcacacaggggagaatcggagcgccccaaaaggggcgaaaatcaaagccggacc

SEQ ID NO: 303764 - DNA, 996 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaa

SEQ ID NO: 303765 - DNA, 1108 bp, Homo sapiens
  misc_feature (989)..(989): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcccaataaagttgtgttttgccacaaaaanaaggggggcgcaaaaatcccagggccagtagggtaccacttgtcaagggccaagagcggtataaagaccgggggtaaaaggcggacagacgggtgaagacctggggacagaaaagagac

SEQ ID NO: 303766 - DNA, 1152 bp, Homo sapiens
  misc_feature (989)..(989): n is a, c, g, or t
  misc_feature (994)..(995): n is a, c, g, or t
  misc_feature (998)..(998): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaaggtttgtgtttatgccaaanaaaannaanaaaaactccggggcactcaatcggggtgcggaaacagcgcgctctgagatgggccaatggtgtccataccgtgttccggacccccttttcttggcacacggcggtaacttcccggccccctataagggggccaataaattccgaagcgggtacg

SEQ ID NO: 303767 - DNA, 1204 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcgagcctcaataaagtttgtgtttatgccaaaaaaaattacagtaatagtagaaagcaatgaggtcgtagaataaagcataatatgccaactaacataacagataaatagaggaggagtaatttattgtggagagagtagaaagatatagtatcaagcagtagtcacataagttgctagacacgttttttgaaagaggagcaatcagggcactagataggggggtgatattagaagaggtgactt

SEQ ID NO: 303768 - DNA, 1288 bp, Homo sapiens
  misc_feature (986)..(986): n is a, c, g, or t
  misc_feature (991)..(991): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagttcgtgtttatgcaancacancaacacacacacacagacacccaaacaaaggacacacaacaaaccaaaacacacaaaaacaaaaagggagcgggcaaaaaaaatacacaagggagcccagcacagccaccaccgtcacacaagccgcccaaaagacgagccaaattacacagcaagcgccgccggtataaacccggtggctgaaaccatgaagcggagtattagagacacctcatcgcggcagcgaacatagcaccaccccgcgacatacaggccgcacaaatatccacatcctggaccacaccacatttgcctaat

SEQ ID NO: 303769 - DNA, 1024 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaagtcgacgcggccgcgaatttagtagtagta

SEQ ID NO: 303770 - DNA, 1356 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaacgttgtgttatgccaccttgaaacactaaaaaaaaagacaagcgagaacaacacacaacaagaaaaacaaagtaaagaagacatagagaggacagcaccagaaccagagatataaccaggatgagcgggcgcggagctgagctacaaatttgtatccctcagtgaagcgaccacaattattcgcgagcacaccaaagtatttatatgaacaaataaagtaccccctcgatagctcaagtcaaatacaagcaacaagcgccgcgcgcccgtgataagaagccgtgcggcttcgaaaagaattcgtttcatggcgtacattaggagcaaccccaccatctggggggcgccagacagctggaccacaccaccgagaattagcctcctagg

SEQ ID NO: 303771 - DNA, 1355 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaggggggggggggtatgaaaaaattttcggggaagcggcgcaacaataaatgagcgtcacaaattttatgtaaataagaggggcacctgattgagggatcatataaataaaagagggagggggggattaacaaagagcgggaggcaaaaacagggttgtaatataggaagaccacactcatgtgggggaaatagggacacacacgaaaatagggggggaaaaaaagaggtatgggaaacaggtatcaggggagaatgttagctgtagaatagg

SEQ ID NO: 303772 - DNA, 1403 bp, Homo sapiens
  misc_feature (1403)..(1403): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagttgtgtttatgccaaaaaaaaaaccaaaacaacaacaaaaaaaaaaaaaagaaactcgacaaacaaaaaaaggggggggacgcgacaaaaaatcagcctagcggcggcccacaaagcagacgccaccaccttcgtggaagaaaaggcaaccaaagagaagcgagaccaaccagacacccggcgagcacgaacacaacgcgagcacgaggagagacccacggcggtatgagaaacaacaacacggcgcgggcacacggcaccaccaccagcaatgacgaggaaaaaactgagtgatggtcaaccgcgttctgcgcggccaaggccggaagaaatagccgccggaaaacgcgaagacagaccgaacagcaacaagagaccatcagtgaacgacgcaaacaggcacgaccgcaccagacaccagtcaggcaccgcn

SEQ ID NO: 303773 - DNA, 1056 bp, Homo sapiens
  misc_feature (987)..(987): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagttgtgtttatgccaaanaaaagaaaataacggaaaagtcgaacaccacagaagaacaaggagatactagctgaagagagaagaggc

SEQ ID NO: 303774 - DNA, 1068 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaagatagggagaaaaaaagttttgcccatagggggtccgattacaattgtcgaaccgccggaaatttagtatagtata

SEQ ID NO: 303775 - DNA, 1126 bp, Homo sapiens
  misc_feature (985)..(985): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcggagaagagaactagtgctgagggcctcataaagttgggttatgcccaaaanaaaaacatacaacacaacaaaaaacggggggcgcaaaaacacaagggccaccagcccctctcttagggccaaggggacataacaggcggggaacagcggaccgggtgttgcaccaccggggggacccgacgcacaaacagg

SEQ ID NO: 303776 - DNA, 979 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcggagaagagaactagtgctgagggcctcataaagttgggttatgcc

SEQ ID NO: 303777 - DNA, 1044 bp, Homo sapiens
  misc_feature (951)..(951): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcggagaaagaaactagggntgaggccctcaataaagttggggttttgccctataataatcttcttttccttatttctataagtcttcatttctctagtatctagtgatttat

SEQ ID NO: 303778 - DNA, 1316 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagttctgtgctttatgccaaaaaaaaaaacaaacacaccacaatcatcaaacaaacaatcatcgaacgctcttatttcccgcagctcccaacaaactaccataactacaacgtggccccatcggacccacagcggctagtctccatcgttggaccccaagagtatcatgtctgcgctacccaccgccggtccaaaacccctcacggggctctccccattatacgatccacgctcgtatagacaatctccccagaaaagcgccaagggttaacccgtcactaagacgcacacgcaacgcgcaaccccgctctacggctcacaccgctccggccgaacctcactagccac

SEQ ID NO: 303779 - DNA, 1274 bp, Homo sapiens
  misc_feature (989)..(989): n is a, c, g, or t
  misc_feature (992)..(992): n is a, c, g, or t
  misc_feature (995)..(995): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgccggagaaagagaactagtgctgagggcctcaataaagtttgtgtttatgccaaaancancangatagaacgcacaaaaacacaagagggcagccacacaataatactcggggaggcacagataagataaccaccatttgtaaaagggccaccaatagagaacatcattaaaagacgcgctataacaagacaggacaaacaccaggcctgtataaacacatttgttgagaggcacacaccacatacgtcgaacattaataagtgtagactcactcgctgttactgatatatcgaacatcatctgagacaagtgcacgctctagatcgataggaagaacctga

SEQ ID NO: 303780 - DNA, 1171 bp, Homo sapiens
  misc_feature (915)..(915): n is a, c, g, or t
  misc_feature (998)..(998): n is a, c, g, or t
  misc_feature (1010)..(1011): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctcnggggaaaccaagactgtgcaggagaaagagaactagtgctgagggcctcaataaagttgtgtttatgccaaccgaaaaaaaanaacaaacacacnnaaaaacaaaactgttttgggggccccctgggcctcagaaaaagttttttaaaaccattcggtttggggcggggggcccatgggttcagtgacctgtgctcacgcggtgtcccaggagacacccgggccgaaaacggctgggttttctcccaattaaaagc

SEQ ID NO: 303781 - DNA, 984 bp, Homo sapiens; identical to SEQ ID NO: 303736

SEQ ID NO: 303782 - DNA, 1161 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaaaaaaaaaaacgatgttgcgggcgcgcgaccggggcccctcggagaaagactcttcgcagaaaccctatgcgggtggggcgcgccggggggcccagaggagaggcaaggggaaacaggggccaaagagggggttcccgagaggagacaaccggga

SEQ ID NO: 303783 - DNA, 1101 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtttaccggcaccgagactgtgccgcaaggcgactatgccggggctcataagttggttttcccccagaaaaaaggggggcgcaaaagccccgaggcacttcggtcccgttttaaagcggcacatggggataaaagagcgggcgttaacggtggacactggttggagccctggggaccccacaacgggaaagg

SEQ ID NO: 303784 - DNA, 1679 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaacaaaaaacaaaaaaaacaaaaacaaaaaacaaaacaaaaacaccaaaaaaaaaaggggggggagaaaaaaactccccacaagaggggcacacgaacaagagacacacaccagacatagtaacacaaagaggggccacacaaggaaggaaaaacaaacacgcgaagaaagaggaacggaaaaaaaaaaaaaaaaagagaagaacacaagagaaacagaaggaaaaaccacacaaaagcacgcaaataccacaccgggggcaaacaaactggggacacaaccacgccaacgagacagcagaacaggagcacatcaagagaacagaagcgaccaggcgcgcaaacaccgcgcgcccaacacatcacaccccgataccaaaaacgaaacaaaagacaacctaccccagaacagacatataacacaagcggcctagacaataaagaaaacaacacaaaacacacaacaaccagccgaaaacgacacgacgaaaacagcaagaagacgaaagggagagcgaggagagaaggaggagagaagagaggcagaggcaacaggaaaaggggagggggaggaggagaggaggagagggagaaagcgcaagggagaggggacaagggggaagaaaggatagaggagaggggaaggaggagaggagagggaggagagagggggaggggagagacaaggggag

SEQ ID NO: 303785 - DNA, 1888 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaacaaaaaaaaaaaaaaaaaaaaaccacaacacaaaaaaaacacgacggggggcgccaccagaacgcccccgcgggggccccaccccccgccccccccactcccgggacaaaagggggcccccagagggggcccgccccatacaaaacaacggcacacgggcgcccacacatccaaaaccgcacaccaacggggcaaccacgcgaaacagggaaaaccacggacaaaacaccccaccacacgcggcagcgcgccacacaaatcgggagcacaacaaaaccccacacaagagagcccattaaagcgcccccaacacggcgaaacaccacaaagaatcaacacacgcgctcaaacgtggctaccaccaccacaacacagacaaaagccctccacccccgaccaacccaccctgggccaaatacgagggattaacatccctccccccggacaccatcttttacccccaggagcatacacagtaaacacacccgccgagcccaaccgacgctccaacaataccgagcaaccaacaccatgccaagcacgagccgcaccccactccccacaaaacagaatgccacacaccacacagcagccaaagccgcagaaggagcagcgcgcgagcctgcacccgacagcgccaggatcccaaaacaggaccaatgaacaaaagagagaccgcgcagaagagggcgacgacggccgcaccggccgcgaccaccgctcggggacagagcgacgccaaccaccgacagacgagcgacacgcgagacaccgcggcgagaagcaacaacaacgaaacagagcagaacgcgggtggagccgcactagctcgagggaatcaataaggagctgagacagacgacaacggaagacgcatgaccacaaacgccggatgcaac

SEQ ID NO: 303786 - DNA, 1124 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcccgaaaaaaaaacaatcacaaaaaaaactctgtgtggcgcggcgggccctcgaaaaagttttgtagaaacccccgttggggggcccgggcccctggtgggacctgggcaaggggtccgggaatccgggccacacaggcggg

SEQ ID NO: 303787 - DNA, 1418 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaggaaaaaaatacacaaataaatagaaaaagaaaaaaaaggggggcggcgcgcgcgcgcacctaaaaagatcttccccgggagggggcccgaaaggtatgtcggcgatccagccagcggtttggtgtgcgcagcaagcgggggcgcccccaaatgaagggggcggtcgctatatatataagaacgcaatacggcgacccgcgcggcggcggggtataacaaaccagcggacgaggacgaggcggaggaaacccagcgcggcgaccacgcgggcagacccctagtggggagagagagagcgccccctcaaactactccgggggcggggcgagcacaaatagtggggggcagcacaacccctccctcacaagaaggaattagtaacccgccccacgaagggacggaacaactagt

SEQ ID NO: 303788 - DNA, 1376 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaacaacaacacccaaacacacacaaaacatacaaacaacaaaacaacggggggcccgcccccccctttttttctcctcctcgcgggctccccccgcgagcttctttccgcaccgcgcatccaccaacctcggggggggccacccttgcggggcgacaaccataacaaagcccctcttaaccaaacggtgatcactccacaaataacctcaaacctagacagaacgctccttgcccaaccccgcccgccacatcctcgcctgacaccacaccagacatacagatcctgccaaaaccacttttaccaaaaaacacactctccaaacacaccatcacctcctctcaaccacttccaccccttatctcataccccaaaccattttatccc

SEQ ID NO: 303789 - DNA, 1408 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaaaaaaaaaaaaaaaaaaaaaaaagggggggcgcaaatccccctgcggggggcgcccaagtatagccgagatacccacgtttctggcggacaaaggggcgcccaaagagggcagcgaatctataaaaagcacacgccgccagcggcccggcgtaaaacacggtcgcgcgcgggcgaaaacccctggtcaccgcgcgccactttggggaagaaccaccccccaccattcgcggggggggcaccaaataggggggcacaacccacccacacacaaagattctacgacgcccacaggggatataatcaaacacttcgaaccgcggctaaacagggcgtacacccacgcggtaaaatcgccgccgccggaaaacttgcggccacggaccacaggcagcgaacatttt

SEQ ID NO: 303790 - DNA, 946 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccgggaaccagactgatgacgctagaggtaccg

SEQ ID NO: 303791 - DNA, 969 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccgggaaccaagactgtgcaggagaaagagaatacggctcgcgccgcaagtgctcc

SEQ ID NO: 303792 - DNA, 1355 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaacaaaaaaaacaacttgggacaccaagtcccctctctttttggcaaaagtgggggccccctgtggacctggccaggcgctgcaacacggggcagaggaggcatgacagccagcggcaccctggaacacccgtgccgcggccggaccatagcgccaaaaatcaacgggggcgccaccacagaaagggcccccaaggaactccgaaacccctgtggagagagcccttccagagaaaccggcagctgcccgtgggaacccagtcctggaacacggcacctcaggtcccgccaaagatacctagcccaccttcacaaggcagcaccacacgccgacacacaaccggcacgccgagcagggcaagccc

SEQ ID NO: 303793 - DNA, 1095 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgccctgtggcgcaaagtgggtctcatgctgccgcggactgacgtcccgggaaccagatgtgcgggaagagactgtgctgaggctataagttgtgtttccaaaaaaaaaaaggggggctaaatcccgaggccattcgtccgtttgaagggcccagagataaaggcggggtacgatggagccggttggcctcgggttgccccaaccgtattttctttgtgttattagatttcccagc

SEQ ID NO: 303794 - DNA, 1625 bp, Homo sapiens
  misc_feature (1625)..(1625): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccgccctgttggcgaaagtgggtctcattgctgccgcggactggacgtctccgggaaccaagactgtgccggagaaagagaactagtgctgagggcctcaataaagtttgtgtttatgccaaaaaaaaaaaaacaaaaaaaaaaaaaaaaaaaaaaaaaaaaaaaaaaaaaaaaaaaaaaaaaaaaaaaaaaaaaaaaagagggggcggcggcgccaacaagaaaatctatcccccgggagggcgccgaaatgacggcgcacaccagcagtttttgttggacagaagaggggcgccccactaatgaggggagcgcttatatatatatagtcgacgacgaggagcaacgcggcgcgcgcgatgatataaataaacacaacgcactgtcagagcgcggaggagaacaacacgccgcgaactaacgcgaggggagacctctctttgtagtgaaaggaagaggagagctctctctctatctgtgtggggggggggagaggagaacaaacatatgtggggagacacacataactacctcctacaaatagagatatattatttagaacgtctcgatgtaggggggtatatatatatataataaattgttaaggaggggtgtgataatagagggtggtgtaaacaaaaaggcggcgtgtattattgtggtgtcggggtggagggagaaaaatatgttgtgtggtatataagtggggagtattatattattttttgaataaaaattaatttattatataacgaggaggggn

SEQ ID NO: 303795 - DNA, 1315 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccgccctgttggcgaaagtgggtctcattgctgccgcggactggacgtctccgggaaccaagactgtgccggagaaagagaactagtgctgagggcctcaataaagtttgtgtttatgccaaaaaaaaaaaaacaaaaaaaaaaaaaaaaaaaaaaaaaaaaaaaaaaaaaaaaaaaaaaaaaaaaaaacaaaaaaaaaaaaaaaaaacacaaacaagaaaaaaaaacacccgcagcggaggcactactcgaaccggtgtgcgccgaaagaaaaaaaacggggctgcgattaaataacgatgcgcccgcgggttgctacaagaggttatctccgttgagacccccatccttttttctaccagacgagggggcaaaaaacctgggggcgaccccccactataagagggggacgcataaaatcaccccgataacacagggtgcaccccggcataa

SEQ ID NO: 303796 - DNA, 1448 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccgccctgttggcgaaagtgggtctcattgctgccgcggactggacgtctccggggaaccaagactgtgcaggagaaagagaactagtgctgagggcctcaataaagtttgtgtttatgccaagaaaaaaaggaaaaaataaggaataaaaaataaagcatagtaaaaaaataaagaaaactaaataataaaaagaaaaagaaaaaaagagggggggggcgtcaaaatatattgcctaatggaggagggcgcaatattgggaccgacaaccctttttttgtttaacaagggggcgcacataaggtagggggcgttatgtaacaggcaagacggggcggcgcgcaccgtctgattattacagaccgcactgggctgaggcggagaaaaaacacgtctcccagtagaggaagtctgggagggcgacacgaccaccaataatcgcggggggggcgacacatgatgggggcaaaaccacctcgagaggggttataagcgccccgggacaaatataaacagctcagaacggtatgagggcggggaacaccacccagcaaattgttccccgggtcaaaaaatggtgccccgc

SEQ ID NO: 303797 - DNA, 1039 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacacggcaagccctccaccatccgcagagatgcccctgctggccgcaaagtgggtctcattgctgcccgccggactggacgtcctgccctcggacggcaacggcgcggcaaccagcgccgtgggcacctgatcgccggcacgtgcggcattcaacggctgcgcagcctgcgctgtggagagggacagcaccgccagcaccgcgctggccag

SEQ ID NO: 303798 - DNA, 1004 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatcctttggaggtggcaaccaccagcacatcggcaagcctccacatcggagagatgccctgttggcgaaagtgggtctcattgctgccgcggactggacgtctccgggaaccaagactgtgcggaagagacactgtggggcacaagtggtttgcaaaaccacaaccccccccaccacccaacaaccccctcttccgcgcacaa

SEQ ID NO: 303799 - DNA, 1298 bp, Homo sapiens
  misc_feature (931)..(931): n is a, c, g, or t
  misc_feature (933)..(933): n is a, c, g, or t
  misc_feature (939)..(939): n is a, c, g, or t
  misc_feature (941)..(941): n is a, c, g, or t
  misc_feature (948)..(949): n is a, c, g, or t
  misc_feature (956)..(956): n is a, c, g, or t
  misc_feature (961)..(961): n is a, c, g, or t
  misc_feature (971)..(971): n is a, c, g, or t
  misc_feature (975)..(975): n is a, c, g, or t
  misc_feature (980)..(981): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgcctgtggagcatccttttggaggtggcaaccaccagcacatcggcaagccctccaccatccgcagagatgcccctgctggccgcaaagtgggtctcattgctgcccgccggactggacgtggactggacgtctccgggggaancnaagacngngcaggannacagagnactantgcgagggcncaanaaagnngcgtaatgccacaaaaaaacaaaacgacaaaacaaaatgtggcggcacagcccaaaaagtctaaacacccgtggagcgcggcgccaagaggaagatagaaagagcagaggggcacaagaagcaccggcgaaaacgaggggttccccaaaaaaaacccggggaccgggtggaaacaacaggggtaggaatcaaggacaaagacagatcacacgcacgcagtccggcagcatagacaacaacaacaagtagagacaacaacacaaggagatgcgcaaaagagcgaagaaaacacaatcagagtatgcgccgcgtcgata

SEQ ID NO: 303800 - DNA, 792 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcagaagcaggaagcagcagaagcaggaagcggcagaagcaggaag

SEQ ID NO: 303801 - DNA, 1339 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcacacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaacaaaaaaaacaacttgggacaccaagtcccctctctttttggcaaaagtgggggccccctgtggacctggccaggcgctgcaacacggggcagaggaggcatgacagccagcggcaccctggaacacccgtgccgcggccggaccatagcgccaaaaatcaacgggggcgccaccacagaaagggcccccaaggaactccgaaacccctgtggagagagcccttccagagaaaccggcagctgcccgtgggaacccagtcctggaacacggcacctcaggtcccgccaaagatacctagcccaccttcacaaggcagcaccacacgccgacacacaaccggcacgccgagcagggcaagccc

SEQ ID NO: 303802 - DNA, 1060 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggcctgacgtctcacacatggtgaggggggtgcttccctgcgcttggagctcagccagcattctaggtgatggatgggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcc

SEQ ID NO: 303803 - DNA, 1281 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggcctgacgtctcacacatggtgaggggggtgcttccctgcgcttggagctcagccagcattctaggtgatggatggaggtgagggccttggcttgcctgcccattgtggattgaagaaactggatgtcagctcacagggtgcaaggggctccctagggtggaggcgagtgggctttttgctgggtagttggatgcagtattgggaaggtgcatgacaggagattgaggggaggtgggggtgctctgaccgactgggggttccctgaggtatctgatcccctacaggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcc

SEQ ID NO: 303804 - DNA, 1072 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggcctgacgtctcacacatggtgaggggggtgcttccctgcgcttggagctcagccagcattctaggtgatggatgggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaa

SEQ ID NO: 303805 - DNA, 1365 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggcctgacgtctcacacatggtgaggggggtgcttccctgcgcttggagctcagccagcattctaggtgatggatggaggtgagggccttggcttgcctgcccattgtggattgaagaaactggatgtcagctcacagggtgcaaggggctccctagggtggaggcgagtgggctttttgctgggtagttggatgcagtattgggaaggtgcatgacaggagattgaggggaggtgggggtgctctgaccgactgggggttccctgaggtatctgatcccctacaggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaagatagggagaaaaaaagttttgcccatagggggtccgattacaattgtcgaaccgccggaaatttagtatagtata

SEQ ID NO: 303806 - DNA, 1264 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctgtcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaaaaaaaaaaaaaaaaaaaaaaaagggggggcgcaaatccccctgcggggggcgcccaagtatagccgagatacccacgtttctggcggacaaaggggcgcccaaagagggcagcgaatctataaaaagcacacgccgccagcggcccggcgtaaaacacggtcgcgcgcgggcgaaaacccctggtcaccgcgcgccactttggggaagaaccaccccccaccattcgcggggggggcaccaaataggggggcacaacccacccacacacaaagattctacgacgcccacaggggatataatcaaacacttcgaaccgcggctaaacagggcgtacacccacgcggtaaaatcgccgccgccggaaaacttgcggccacggaccacaggcagcgaacatttt

SEQ ID NO: 303807 - DNA, 941 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctgggcagcagttgaatgctgagggctgtgggtgaacatgctgtgagtgccggtggacagccagtggctagacttggtccctggaattcgattacctgttgttctaaaacttgggttctgtaagtttgagctcatcctgtagtctcagttgtcatcactgtacaacaggcacaacagtacctgctttactgctgttgaggcgttaaatgagattgggacgaagtcaccagggtcttggattctaccgtgggcttcct

SEQ ID NO: 303808 - DNA, 954 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcaaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcc

SEQ ID NO: 303809 - DNA, 953 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgacctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcc

SEQ ID NO: 303810 - DNA, 1646 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaacaacacaaaccccaccacacacacccacacacacccacccccccaaccacacccacaccacaaacaaccgcggcgccgccaaacaacatctcctcccgcgcgcgccagcagctacccgccaacccacccccctctcgtatcgaccaagcgcgccccccacaacagcgcgagccctcacacacccagcccacgcccgcgcgccggcatacaccaccaccccccacccagccacacaaccgtgccaccgggcaccccaccagcaacacgaccccccacccgcgtgcggaggcacaacctgcgcgacgaaaccaccacgccactctcacccccggccaccacacacccccgccgctactcgtctgccccccaccatctcctcgccgccgccaccactcccccacgccctctctcgccacacctcccgcccgacctccccctcaccccgcctccccactcccctccccccagccgcccccgccccccggccctccctccctcccgccgccgcctccgcatccacgctccccacctcacctcctccacccccgcccaccgccgcctcgacctcctcacgctccccactacccacccactccactccgcccgcccctactacccgcgcactcgccgcagcctcccacgcactacacc

SEQ ID NO: 303811 - DNA, 943 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcc

SEQ ID NO: 303812 - DNA, 1335 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaacaacaacacccaaacacacacaaaacatacaaacaacaaaacaacggggggcccgcccccccctttttttctcctcctcgcgggctccccccgcgagcttctttccgcaccgcgcatccaccaacctcggggggggccacccttgcggggcgacaaccataacaaagcccctcttaaccaaacggtgatcactccacaaataacctcaaacctagacagaacgctccttgcccaaccccgcccgccacatcctcgcctgacaccacaccagacatacagatcctgccaaaaccacttttaccaaaaaacacactctccaaacacaccatcacctcctctcaaccacttccaccccttatctcataccccaaaccattttatccc

SEQ ID NO: 303813 - DNA, 1078 bp, Homo sapiens
  misc_feature (793)..(793): n is a, c, g, or t
  misc_feature (796)..(796): n is a, c, g, or t
  misc_feature (799)..(799): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcggagaaagagaactagtgctgagggcctcaataaagtttgtgtttatgccaaaancancangatagaacgcacaaaaacacaagagggcagccacacaataatactcggggaggcacagataagataaccaccatttgtaaaagggccaccaatagagaacatcattaaaagacgcgctataacaagacaggacaaacaccaggcctgtataaacacatttgttgagaggcacacaccacatacgtcgaacattaataagtgtagactcactcgctgttactgatatatcgaacatcatctgagacaagtgcacgctctagatcgataggaagaacctga

SEQ ID NO: 303814 - DNA, 928 bp, Homo sapiens
  misc_feature (833)..(833): n is a, c, g, or t
  misc_feature (840)..(840): n is a, c, g, or t
  misc_feature (844)..(844): n is a, c, g, or t
  misc_feature (846)..(847): n is a, c, g, or t
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcacacgagtacggggtgtggccatgaatcctgtggagcggcacatgggagcggcacatgcgttgggagcggcacatgcgttgggancggcacntgcncnnggagcggcacatgcgttgggagcggcacatgcgttgggagcggcacatgcgttgggagcggcacatgcgttgggagcggca

SEQ ID NO: 303815 - DNA, 741 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctgaacccatcttgaagcgctggtccgcagcggacctggggatcctcttcgagtcga

SEQ ID NO: 303816 - DNA, 845 bp, Homo sapiens
gtttgtgttgctccttttcgtctgcttctggccttttgaagatgattatatttatttttttgtggactacttgactgtgaggacccacaggtggacaaaagcaggcttgtaaatcgtcggcagtaattacggtctaggtacgaggctgggtgttcgggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcagaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccgggaaccaagactgtgcaggagaaagagaatacggctcgcgccgcaagtgctcc

SEQ ID NO: 303817 - DNA, 366 bp, Homo sapiens
atcttgaaggctggccgggcgtaccacaaatataaggcacacgagtacggggtgtggccatgaatgtaagtaacccagaaatgcagggttgggtattgaagttacagtggccacactgttgggtaggcaagtcccatccacaggtgtccctgcaggagggggatctacggtgggaggagcagcaggtggtggtttgtagtcacgggactgttgatcctgctccagcactcctgaaggaggtgggctcaccctccttcaccgtttctccgcaagaaacggaggctgggaggggcagtgggggcctgagctggaaagagtcagcctgactggggttgtctagcggcacatgctgtggagaggggcttc

SEQ ID NO: 303818 - DNA, 2162 bp, Homo sapiens
ggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggaaaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtca

SEQ ID NO: 303819 - DNA, 2356 bp, Homo sapiens
ggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggaaaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattttagtcctgaacgctacggggaaaatgcattttcttcagaattatccattacgtgcatttaaactctgccagaaaaaaataactattttgttttaatctactttttgtatttagtagttatttgtataaattaaataaactgttttcaagtcaaacagtgaaattgtttttcaaaatataaaaaagatctgtgtaacattatgcattttcttatgggagcaatagaagcacaaaactaatttgtaaattgaatttgctttttaaatctactcatgaacttatgtaagacatcataaggatgtcttacagcttgaatttggtataagaaaatttgtttcttcctttgg

SEQ ID NO: 303820 - DNA, 2179 bp, Homo sapiens
ggcgcaaccaagaacgcctcaatccccgagacgtggagtatggcactatcgaagggctcatcaccaccaatgttggagacagcactttagcagatttattggatcattcgtgtacatcaggaagtggctctggtcttccttttctggtacaaagaacagtggctcgccagattacactgttggagtgtgtcgggaaaggcaggtatggtgaggtgtggaggggcagctggcaaggggaaaatgttgccgtgaagatcttctcctcccgtgatgagaagtcatggttcagggaaacggaattgtacaacactgtgatgctgaggcatgaaaatatcttaggtttcattgcttcagacatgacatcaagacactccagtacccagctgtggttaattacacattatcatgaaatgggatcgttgtacgactatcttcagcttactactctggatacagttagctgccttcgaatagtgctgtccatagctagtggtcttgcacatttgcacatagagatatttgggacccaagggaaaccagccattgcccatcgagatttaaagagcaaaaatattctggttaagaagaatggacagtgttgcatagcagatttgggcctggcagtcatgcattcccagagcaccaatcagcttgatgtggggaacaatccccgtgtgggcaccaagcgctacatggcccccgaagttctagatgaaaccatccaggtggattgtttcgattcttataaaagggtcgatatttgggcctttggacttgttttgtgggaagtggccaggcggatggtgagcaatggtatagtggaggattacaagccaccgttctacgatgtggttcccaatgacccaagttttgaagatatgaggaaggtagtctgtgtggatcaacaaaggccaaacatacccaacagatggttctcagacccgacattaacctctctggccaagctaatgaaagaatgctggtatcaaaatccatccgcaagactcacagcactgcgtatcaaaaagactttgaccaaaattgataattccctcgacaaattgaaaactgactgttgacattttcatagtgtcaagaaggaagatttgacgttgttgtcattgtccagctgggacctaatgctggcctgactggttgtcagaatggaatccatctgtctccctccccaaatggctgctttgacaaggcagacgtcgtacccagccatgtgttggggagacatcaaaaccaccctaacctcgctcgatgactgtgaactgggcatttcacgaactgttcacactgcagagactaatgttggacagacactgttgcaaaggtagggactggaggaacacagagaaatcctaaaagagatctgggcattaagtcagtggctttgcatagctttcacaagtctcctagacactccccacgggaaactcaaggaggtggtgaatttttaatcagcaatattgcctgtgcttctcttctttattgcactaggaattctttgcattccttacttgcactgttactcttaattttaaagacccaacttgccaaaatgttggctgcgtactccactggtctgtctttggataataggaattcaatttggcaaaacaaaatgtaatgtcagactttgctgcattttacacatgtgctgatgtttacaatgatgccgaacattaggaattgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattttagtcctgaacgctacggggaaaatgcattttcttcagaattatccattacgtgcatttaaactctgccagaaaaaaataactattttgttttaatctacttttttgacttgaaaacagtttatttaatttagcacaaataactactaaatacaaaaagtaggtcgagc

SEQ ID NO: 303821 - DNA, 514 bp, Homo sapiens
agaatacagtactcaggttttagatttgatgttcttttaggatggttgatgaatggtctgttcctaaaatatcaacatgctgaagggcttggcactatcattatgggtgagcacaaagatattattgctatctgaaacttaaggaatgtaaaatatcttttaaagtattacttataatgaaatgaatatgaaattttcctattagcagtgcccttttaaggaataaatgctattatttttctctgttgatgcttctgtaaacctcctcttagggcaattggtcagtttaattactttttgttacagatgacatttactgtgtaggtcgctatttctaaatactttaagttataatgtggaatcctcatgtatattaatttttttcttgctctctccaggtttcattgcttcagacatgacatcaagacactccagtacccagctgtggttaattacacattatcatgaaatgggatcgttgtacgactatcttcagcttactactctggataca

SEQ ID NO: 303822 - DNA, 988 bp, Homo sapiens
agcggacggaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatgatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttcca

SEQ ID NO: 303823 - DNA, 1028 bp, Homo sapiens
agcggacggaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttcca

SEQ ID NO: 303824 - DNA, 1435 bp, Homo sapiens
agcggacggaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggtaagttacctactgcattcatgggctgggccaaggtcagtgggatagtgtacatgaataaactttgaaaagtgcaaaaatactgtagttaagtatgagagagattttattctttagtactttgaattttatggcatgccttctactggttaaaactatttttgtttttacacctaacatttattaaatatgggggtgtaccttagttttgacacttttcttttgctgtatgaaaatttgtgcctgacttaagtctaaaatcaaacatttccctttttcctcctttttttctcctcatttctacatttattctgtgtatgtgtttagaaggaataaattcttgaatactggacctcagggaactttagagatcagctagtcaagttcattattttacaaaataagacttgagcgtttaggataatttataaaatacatacaataaactacatgtatttaatgtacagtttaatatgttttggcatatatacacacccataaaagttatgaatttttataaatggaatcatataatatgtgctttttttgtctggcttctttcattcagtctaattaccttggtatttattcatgttgtagcatgtatcaatagttcatgcctttttattgctgagtaatgtctgttatgtggataccatagcttgtttattcacctattgagggaaattagattgtttccatattttctattacaaaataaaggtactagat

SEQ ID NO: 303825 - DNA, 1127 bp, Homo sapiens
agcggacggaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtcacaggatatttctgactggatttgattcttaaaaccaatttccatgggtcagaattggcatttcagacgtgcagtgatctccgagaactgtagaattaaacctatacaggacgaagcttggcagctagaaaacagagctggaaactggcacggctgaattattttcaccgaagactttgtttcctaagaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaaggtatataatgcataagtattgtatttcacttattttctaatatgaaaacaactgaaatctattaatatttttgctgttgctcattgtagcatcttaaatcttttttttttctcagttggtattgtatctgagatcagttttggggttattctgtgcttcggatgttgttacagtgctaaattaaagtggcttggcagggccactttaatattaatgtttctgtcacactggtctccaggaatccgctctatatgcatgcatttattgacaaaggagatagttaacaccttccttataataggtatttaggttcttagacagtcaaagctttttagggaattag

SEQ ID NO: 303826 - DNA, 659 bp, Homo sapiens
agcggacggaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattgcctcatcatctcacttcttttatcctggtgaacccgatcctccgccaccgcccgtccggtttgtttttgggtgggaaggggcccccccctgaccctgagggtgtgtctttgttctggtcgcttgtccaactgcatcaaaaaaat

SEQ ID NO: 303827 - DNA, 3837 bp, Homo sapiens
agcggacggaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaatttgctactgttttagaccatattttcctattatttatctgttcaaatttgtattattacaactaatagctcttgaattctttgctaaaggtaacagcaacacttccagaggcttctaaaacactactgttttgcagggcaggagtattctggaatctttttacttagatataaaataaacctcgaatattaaaaagttgtagccatctgagagaggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctaaattactataggtcatttaatattggtttatggtgcttttatttccttaacttgaaaacatctttctgagatttcagagtcctcaaatttcttagattaagagacaagaggccagtgcagtggttcacacctgtaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaattgcttgaacccaggaggtggaggttgcagtgagccgagatcacaccactgcactccagcctgggagacagaacgagactcctaatcaaaaaaaaacacaagaaaatagagtgaggcttttttaccgtatatacataaaatacttatgaaaattagaagataatttggcattccctactgtttcactgtacttccattgaaatactctttccattaaaatattctgaaacaatatagtaataatggaattgtgatcttcagttgcacctcaaccattttttttgcttatgaactaaaatttctaacattaacatttcggcatgtaataaaacaagggcctatctcctttaaaatttaacattccatgtaacttttctgacttatcattcataagttgcaaatattactattttcctaaaccagggtacacaatttaagttgccacttattgatgacagaatttctggatagtaggattttaataggcgagcaaataaaattcaaatcaatttcaaggaaaaacatctggccaggggtagcttgatttcgcccccaaaaatactgaagactaatccattgacattcataatgggacagctaagtaccaaatagctaactactccctatggaggtttatgcaagcagagtaccaggggttccatcatatcaacctggcaatgcacttggtggttgtgtgaccttgagaaagtctcttactcttgtttatgtgttcttactttagaaactgagactttatttgtggttttcacactatttcagcagcaaaaactttttcaaggaaaatcttacagaacctttaaacacgtgtgcatacacacataccctataccccactatataaaagtcatattattataaatttccttattatataaactttatatactataaatgtgattaagtcaatgaataaaaacattaatgcattggtgatatccagcatgtttgaatttggtgagtaacacacatatagtgggagtcgttttttttaaaaaaattttttaattaaattcaagtcaaatttgcagaaccctgtatctcctccatagattcttagtattccatggaacatattttgaaaaccttgggatagatgatccactgaaatcttttccagctctaagattttaaattgtccttttagattagacttgctgagtttaattcagattacctaattttaaaatgtttctgaaaagtgaacagagttaccttacagagttttggatctttccagggatagccaatgattttatcccccagaatccttcacctttcaaggagttatttaacaatgagcccagtgactcaatagggcccaaacctttttattttacaatatgagctccaagacacttactgatctactgtgaatataaaatgttattagccttatcaaataaataaatgagcacagctctttgttcgctctattgaactgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtga

SEQ ID NO: 303828 - DNA, 4101 bp, Homo sapiens
agcggacggaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaatttgctactgttttagaccatattttcctattatttatctgttcaaatttgtattattacaactaatagctcttgaattctttgctaaaggtaacagcaacacttccagaggcttctaaaacactactgttttgcagggcaggagtattctggaatctttttacttagatataaaataaacctcgaatattaaaaagttgtagccatctgagagaggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctaaattactataggtcatttaatattggtttatggtgcttttatttccttaacttgaaaacatctttctgagatttcagagtcctcaaatttcttagattaagagacaagaggccagtgcagtggttcacacctgtaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaattgcttgaacccaggaggtggaggttgcagtgagccgagatcacaccactgcactccagcctgggagacagaacgagactcctaatcaaaaaaaaacacaagaaaatagagtgaggcttttttaccgtatatacataaaatacttatgaaaattagaagataatttggcattccctactgtttcactgtacttccattgaaatactctttccattaaaatattctgaaacaatatagtaataatggaattgtgatcttcagttgcacctcaaccattttttttgcttatgaactaaaatttctaacattaacatttcggcatgtaataaaacaagggcctatctcctttaaaatttaacattccatgtaacttttctgacttatcattcataagttgcaaatattactattttcctaaaccagggtacacaatttaagttgccacttattgatgacagaatttctggatagtaggattttaataggcgagcaaataaaattcaaatcaatttcaaggaaaaacatctggccaggggtagcttgatttcgcccccaaaaatactgaagactaatccattgacattcataatgggacagctaagtaccaaatagctaactactccctatggaggtttatgcaagcagagtaccaggggttccatcatatcaacctggcaatgcacttggtggttgtgtgaccttgagaaagtctcttactcttgtttatgtgttcttactttagaaactgagactttatttgtggttttcacactatttcagcagcaaaaactttttcaaggaaaatcttacagaacctttaaacacgtgtgcatacacacataccctataccccactatataaaagtcatattattataaatttccttattatataaactttatatactataaatgtgattaagtcaatgaataaaaacattaatgcattggtgatatccagcatgtttgaatttggtgagtaacacacatatagtgggagtcgttttttttaaaaaaattttttaattaaattcaagtcaaatttgcagaaccctgtatctcctccatagattcttagtattccatggaacatattttgaaaaccttgggatagatgatccactgaaatcttttccagctctaagattttaaattgtccttttagattagacttgctgagtttaattcagattacctaattttaaaatgtttctgaaaagtgaacagagttaccttacagagttttggatctttccagggatagccaatgattttatcccccagaatccttcacctttcaaggagttatttaacaatgagcccagtgactcaatagggcccaaacctttttattttacaatatgagctccaagacacttactgatctactgtgaatataaaatgttattagccttatcaaataaataaatgagcacagctctttgttcgctctattgaactgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtgaattttagctaattgaagagattattttcctatgtaatttcacattctaatatactaaatgtttatattccttagagaactattttatattgtgcgctgggggcttgtgatgtttgtgtgctgttttaaaattcatttcaaattggactcgatttccttatatctaatatatatctgggagaaaaggctgcttgaaaatatcttttgattcagtgatttttaacattgggaagttgagtttattaaaaggtagtctgaagaattt

SEQ ID NO: 303829 - DNA, 2803 bp, Homo sapiens
agcggacggaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaatttgctactgttttagaccatattttcctattatttatctgttcaaatttgtattattacaactaatagctcttgaattctttgctaaaggtaacagcaacacttccagaggcttctaaaacactactgttttgcagggcaggagtattctggaatctttttacttagatataaaataaacctcgaatattaaaaagttgtagccatctgagagaggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctaaattactataggtcatttaatattggtttatggtgcttttatttccttaacttgaaaacatctttctgagatttcagagtcctcaaatttcttagattaagagacaagaggccagtgcagtggttcacacctgtaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaattgcttgaacccaggaggtggaggttgcagtgagccgagatcacaccactgcactccagcctgggagacagaacgagactcctaatcaaaaaaaaacacaagaaaatagagtgaggcttttttaccgtatatacataaaatacttatgaaaattagaagataatttggcattccctactgtttcactgtacttccattgaaatactctttccattaaaatattctgaaacaatatagtaataatggaattgtgatcttcagttgcacctcaaccattttttttgcttatgaactaaaatttctaacattaacatttcggcatgtaataaaacaagggcctatctcctttaaaatttaacattccatgtaacttttctgacttatcattcataagttgcaaatattactattttcctaaaccagggtacacaatttaagttgccacttattgatgacagaatttctggatagtaggattttaataggcgagcaaataaaattcaaatcaatttcaaggaaaaacatctggccaggggtagcttgatttcgcccccaaaaatactgaagactaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaactgcttgaacccaggaggtggaggttgcagtgagccgagatcacaccactgcactccagcctgggagacagaacgagactccc

SEQ ID NO: 303830 - DNA, 3882 bp, Homo sapiens
ggttccagttgcccggggtggcggtggcttgtcccgcctcggggtggttctgagggacccggagagagtttttccttctctatcccaaaacggttgtttgaatattgccgccggctcagtcattcggccgccggacttagctgttggttaaatgtccagaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaatttgctactgttttagaccatattttcctattatttatctgttcaaatttgtattattacaactaatagctcttgaattctttgctaaaggtaacagcaacacttccagaggcttctaaaacactactgttttgcagggcaggagtattctggaatctttttacttagatataaaataaacctcgaatattaaaaagttgtagccatctgagagaggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctaaattactataggtcatttaatattggtttatggtgcttttatttccttaacttgaaaacatctttctgagatttcagagtcctcaaatttcttagattaagagacaagaggccagtgcagtggttcacacctgtaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaattgcttgaacccaggaggtggaggttgcagtgagccgagatcacaccactgcactccagcctgggagacagaacgagactcctaatcaaaaaaaaacacaagaaaatagagtgaggcttttttaccgtatatacataaaatacttatgaaaattagaagataatttggcattccctactgtttcactgtacttccattgaaatactctttccattaaaatattctgaaacaatatagtaataatggaattgtgatcttcagttgcacctcaaccattttttttgcttatgaactaaaatttctaacattaacatttcggcatgtaataaaacaagggcctatctcctttaaaatttaacattccatgtaacttttctgacttatcattcataagttgcaaatattactattttcctaaaccagggtacacaatttaagttgccacttattgatgacagaatttctggatagtaggattttaataggcgagcaaataaaattcaaatcaatttcaaggaaaaacatctggccaggggtagcttgatttcgcccccaaaaatactgaagactaatccattgacattcataatgggacagctaagtaccaaatagctaactactccctatggaggtttatgcaagcagagtaccaggggttccatcatatcaacctggcaatgcacttggtggttgtgtgaccttgagaaagtctcttactcttgtttatgtgttcttactttagaaactgagactttatttgtggttttcacactatttcagcagcaaaaactttttcaaggaaaatcttacagaacctttaaacacgtgtgcatacacacataccctataccccactatataaaagtcatattattataaatttccttattatataaactttatatactataaatgtgattaagtcaatgaataaaaacattaatgcattggtgatatccagcatgtttgaatttggtgagtaacacacatatagtgggagtcgttttttttaaaaaaattttttaattaaattcaagtcaaatttgcagaaccctgtatctcctccatagattcttagtattccatggaacatattttgaaaaccttgggatagatgatccactgaaatcttttccagctctaagattttaaattgtccttttagattagacttgctgagtttaattcagattacctaattttaaaatgtttctgaaaagtgaacagagttaccttacagagttttggatctttccagggatagccaatgattttatcccccagaatccttcacctttcaaggagttatttaacaatgagcccagtgactcaatagggcccaaacctttttattttacaatatgagctccaagacacttactgatctactgtgaatataaaatgttattagccttatcaaataaataaatgagcacagctctttgttcgctctattgaactgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtga

SEQ ID NO: 303831 - DNA, 4026 bp, Homo sapiens
agcggacggaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtcacaggatatttctgactggatttgattcttaaaaccaatttccatgggtcagaattggcatttcagacgtgcagtgatctccgagaactgtagaattaaacctatacaggacgaagcttggcagctagaaaacagagctggaaactggcacggctgaattattttcaccgaagactttgtttcctaagaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaatttgctactgttttagaccatattttcctattatttatctgttcaaatttgtattattacaactaatagctcttgaattctttgctaaaggtaacagcaacacttccagaggcttctaaaacactactgttttgcagggcaggagtattctggaatctttttacttagatataaaataaacctcgaatattaaaaagttgtagccatctgagagaggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctaaattactataggtcatttaatattggtttatggtgcttttatttccttaacttgaaaacatctttctgagatttcagagtcctcaaatttcttagattaagagacaagaggccagtgcagtggttcacacctgtaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaattgcttgaacccaggaggtggaggttgcagtgagccgagatcacaccactgcactccagcctgggagacagaacgagactcctaatcaaaaaaaaacacaagaaaatagagtgaggcttttttaccgtatatacataaaatacttatgaaaattagaagataatttggcattccctactgtttcactgtacttccattgaaatactctttccattaaaatattctgaaacaatatagtaataatggaattgtgatcttcagttgcacctcaaccattttttttgcttatgaactaaaatttctaacattaacatttcggcatgtaataaaacaagggcctatctcctttaaaatttaacattccatgtaacttttctgacttatcattcataagttgcaaatattactattttcctaaaccagggtacacaatttaagttgccacttattgatgacagaatttctggatagtaggattttaataggcgagcaaataaaattcaaatcaatttcaaggaaaaacatctggccaggggtagcttgatttcgcccccaaaaatactgaagactaatccattgacattcataatgggacagctaagtaccaaatagctaactactccctatggaggtttatgcaagcagagtaccaggggttccatcatatcaacctggcaatgcacttggtggttgtgtgaccttgagaaagtctcttactcttgtttatgtgttcttactttagaaactgagactttatttgtggttttcacactatttcagcagcaaaaactttttcaaggaaaatcttacagaacctttaaacacgtgtgcatacacacataccctataccccactatataaaagtcatattattataaatttccttattatataaactttatatactataaatgtgattaagtcaatgaataaaaacattaatgcattggtgatatccagcatgtttgaatttggtgagtaacacacatatagtgggagtcgttttttttaaaaaaattttttaattaaattcaagtcaaatttgcagaaccctgtatctcctccatagattcttagtattccatggaacatattttgaaaaccttgggatagatgatccactgaaatcttttccagctctaagattttaaattgtccttttagattagacttgctgagtttaattcagattacctaattttaaaatgtttctgaaaagtgaacagagttaccttacagagttttggatctttccagggatagccaatgattttatcccccagaatccttcacctttcaaggagttatttaacaatgagcccagtgactcaatagggcccaaacctttttattttacaatatgagctccaagacacttactgatctactgtgaatataaaatgttattagccttatcaaataaataaatgagcacagctctttgttcgctctattgaactgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtga

SEQ ID NO: 303832 - DNA, 919 bp, Homo sapiens
gcgcgggcctggttggtaaagtagtatatggtcatacctgtttcctagagaggatcctggtcaatgactattcgctgtgccatattcgccgaatacacatgaatgctccgtcgatagactgctcgttctgccacagggatccatatgggaactgctggtcgattacgaggatcctattgacaaggtctgtttcccagcgtcttctcgattatcaattgatcgctctccgagcattagacttgctgagtttaattcagattacctaattttaaaatgtttctgaaaagtgaacagagttaccttacagagttttggatctttccagggatagccaatgattttatcccccagaatccttcacctttcaaggagttatttaacaatgagcccagtgactcaatagggcccaaacctttttattttacaatatgagctccaagacacttactgatctactgtgaatataaaatgttattagccttatcaaataaataaatgagcacagctctttgttcgctctattgaactgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtga

SEQ ID NO: 303833 - DNA, 938 bp, Homo sapiens
agcggacggaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaaggtatataatgcataagtattgtatttcacttattttctaatatgaaaacaactgaaatctattaatatttttgctgttgctcattgtagcatcttaaatcttttttttttctcagttggtattgtatctgagatcagttttggggttattctgtgcttcggatgttgttacagtgctaaattaaagtggcttggcagggccactttaatattaatgtttctgtcacactggtctccaggaatccgctctatatgcatgcatttattgacaaaggagatagttaacaccttccttataataggtatttaggttcttagacagtcaaagctttttagggaattag

SEQ ID NO: 303834 - DNA, 494 bp, Homo sapiens
gcctcccaaagtgttgatattacaggcgtgagccaccatgacctgccttgtttatattttgacgggttgatttgcaagagaatgtgacttcagaagaaagaaaagggtgatggtaggaagtatattctgtgccagcacctctggtcatctaggccagcatcctaggaattatccagttctctctctttgccacttcatgtatgttgaggtaatcagtgaagagcgttagtcccacctcctaaatattggtctggtcttacgcttctttcctctacctttatcattagcttaatttgagccttcatctcccacatagttattgagtctcacgcttcagtcctttctttctaacccatctttcatattttcgtcccatttaatgattctccaaatagaacctttttatgatttcccactttatacagaatagccgaagcctttattgatgtttacatgcttacccgcctggcccttgccccatactcttttcttag

SEQ ID NO: 303835 - DNA, 3197 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303836 - DNA, 3242 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303837 - DNA, 3250 bp, Homo sapiens
tggccgtccgcaaagtgctcagatacagccatgcagaacgcgtgactaacatatacacggacacgcacgagagcagggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303838 - DNA, 3335 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303839 - DNA, 3287 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303840 - DNA, 3290 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303841 - DNA, 3380 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgctgcctccatctagtacaaaacctccagctttgagtcattcagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303842 - DNA, 3825 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtacaaaggttatcttttttctgtcttggtttgttattgttgttgctgttcattttagactttatttctttgatattaactatcagtcatacaaaataactgaaaagaaacaattttagtatttaactctgtcttgtattcatttctatgccagatgaatgacacgaaattcacataaaattctgctgttgtgattttttgtgcttttccagggttcttagcacgttatgtacattgcatgggtatatgcttttaatatttttatgtataaaaagtgaattacaacaactttttggaattgaaacatgggcatttttatctaagtaagtcaacaatggcataattcatataaatgaaatgagagcaataactcccaagtggttgatcttctaacattattttgtttcctagtgctgcctccatctagtacaaaacctccagctttgagtcattcaggtttagtagcttcttccttatatgtcttcttccttatatgttacaagatataaggaattcctggagaaattgccagcaataactcccaagtgtttggtccaatctacattattattttgttttccagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303843 - DNA, 3144 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggctggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303844 - DNA, 3783 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtacaaaggttatcttttttctgtcttggtttgttattgttgttgctgttcattttagactttatttctttgatattaactatcagtcatacaaaataactgaaaagaaacaattttagtatttaactctgtcttgtattcatttctatgccagatgaatgacacgaaattcacataaaattctgctgttgtgattttttgtgcttttccagggttcttagcacgttatgtacattgcatgggtatatgcttttaatatttttatgtataaaaagtgaattacaacaactttttggaattgaaacatgggcatttttatctaagtaagtcaacaatggcataattcatataaatgaaatgagagcaataactcccaagtggttgatcttctaacattattttgtttcctagtgctgcctccatctagtacaaaacctccagctttgagtcattcaggtttagtagcttcttccttatatgtcttcttccttatatgttacaagatataaggaattcctggagaaattgccagcaataactcccaagtgtttggtccaatctacattattattttgttttccagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303845 - DNA, 3133 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccataggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303846 - DNA, 3357 bp, Homo sapiens
ggatttcttaactagcaccgagttaagcatattttctcattaattgtcagcatttcttgtgatgactagaacagaacttagcatggccttccaaataaatacaggcgtattaggccgttttcgtattgctctaaagaaatacctgagactgggtaatttataaagaaaagaagtttaattggctcatgtttctacaagctgtacaggaagcatggtgctggcatctgctgggggtttgggtaggcctcgggaaacttaacaaccattgggaaagacagaaggagagcaaggtgtctcacatggcaggagcaggaggagcaaggtggggaggacgggaggtgttgcgcacttttaaataaccagatctcccaagcactcagtatcacgagaacagcaccaaggggacggtgctaaaccattcatgagaaatccacccccatgattcagacccctcccaccaggccccacctccaacattgtggactacaatttgacatgcgatttggtggggacacagatccaaaccatatcaataggtatttacactttaagaaaatgagatttgttctgaaagttagttactacattaatggtttgaatttgggatgatatatttgctcatagaaaccttcttttaaatccatattgaattcacaaacagcttgtagaaaccctatattgacaaatttattgaagacacagaaattttactaatgctgtcttaatcttttacatttcctttcctctttttcttcatttttaagaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303847 - DNA, 3920 bp, Homo sapiens
tagcaactccaagctgctcacaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacctgtaataccagaactttgggaggccgaggtgggtggatcacgaggtcagaagttcaagaccagcctggctaagttggtgaaaccccatctctactaaaaatacaaaaattagcggggtgcggtggcaggcacttgtaatcccagctgctcgggaggccgaggcaggagaatcgcttgaacccagtgggcagaggttgcagtgagccaagatcatgccactgcactccagcctgggtgacagagtgagactctgtctcaaaacaaaaaccttcttataattcctgtaagagcttggtaactggtagcctcctgagttgagtgctgtagggtttgaggggcaggaagagatgagttttttagtggactgatacatgagcaaaacaagattgcatgtgaaatttatactcagtgaggcatccgggcttaactcacatgctcctagtgggtatatgcactaatactacgtttgttgatacagtcttttgaaagagttgatgataagcatttcataaagtatttataaaacactggtatagcttagtgttggagagcagaagagagaattgcttgggattgtcaatgatttcttatcatctgctagaggaagacttaataacaacatcatgatgttaaggtagatctaaatgtgttaacaagaagaaaagttgaggaagtcctaagtggaaaagagaaagatgtaaattatgtagtatcatactacttacagtttttaaaaagatacatatgtttaccccaagcacattccctttttttttttttgagacagagtcttgctctgtcacccaggatggcgtgcagtggcgcggtcttggctcactgcaacctccgcctcccgggttcaagcggttctcctgccacctcagactcccaagtagctggtattacaggcacccgccactatgccggctagttttttgtgtttttagtagagacggggtttctccatgatggcctggctagtctcgaactcctgacctcaagtgattcacctgcctcggcctcccacagtgctgggattacaggcgtgagccaccacacccatcctcacattactttcatgatggttatcttctaagatttccattataaaatacagagtgtggtgagcattcttgtacatacatcttacatacttgtgcaaatatatatgtaggttaaattctaagatgtggaattgcaaagtttgtaaagtgtgtagttttcatttgataaacttaaaaaatcaatatcaaaattaaagtcataattttatattgataaggccctggtgaattataaaatcaaacttatttttcgtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303848 - DNA, 2911 bp, Homo sapiens
tagcaactccaagctgctcacaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacacctgcctcggcctcccacagtgctgggattacaggcgtgagccaccacacccatcctcacattactttcatgatggttatcttctaagatttccattataaaatacagagtgtggtgagcattcttgtacatacatcttacatacttgtgcaaatatatatgtaggttaaattctaagatgtggaattgcaaagtttgtaaagtgtgtagttttcatttgataaacttaaaaaatcaatatcaaaattaaagtcataattttatattgataaggccctggtgaattataaaatcaaacttatttttcgtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303849 - DNA, 2757 bp, Homo sapiens
tggccgtccgcaaagtgctcagatacagccatgcagaacgcgtgactaacatatacacggacacgcacgagagcagggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgacctgcctcggcctcccacagtgctgggattacaggcgtgagccaccacacccatcctcacattactttcatgatggttatcttctaagatttccattataaaatacagagtgtggtgagcattcttgtacatacatcttacatacttgtgcaaatatatatgtaggttaaattctaagatgtggaattgcaaagtttgtaaagtgtgtagttttcatttgataaacttaaaaaatcaatatcaaaattaaagtcataattttatattgataaggccctggtgaattataaaatcaaacttatttttcgatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303850 - DNA, 4013 bp, Homo sapiens
tagcaactccaagctgctcacaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacctgtaataccagaactttgggaggccgaggtgggtggatcacgaggtcagaagttcaagaccagcctggctaagttggtgaaaccccatctctactaaaaatacaaaaattagcggggtgcggtggcaggcacttgtaatcccagctgctcgggaggccgaggcaggagaatcgcttgaacccagtgggcagaggttgcagtgagccaagatcatgccactgcactccagcctgggtgacagagtgagactctgtctcaaaacaaaaaccttcttataattcctgtaagagcttggtaactggtagcctcctgagttgagtgctgtagggtttgaggggcaggaagagatgagttttttagtggactgatacatgagcaaaacaagattgcatgtgaaatttatactcagtgaggcatccgggcttaactcacatgctcctagtgggtatatgcactaatactacgtttgttgatacagtcttttgaaagagttgatgataagcatttcataaagtatttataaaacactggtatagcttagtgttggagagcagaagagagaattgcttgggattgtcaatgatttcttatcatctgctagaggaagacttaataacaacatcatgatgttaaggtagatctaaatgtgttaacaagaagaaaagttgaggaagtcctaagtggaaaagagaaagatgtaaattatgtagtatcatactacttacagtttttaaaaagatacatatgtttaccccaagcacattccctttttttttttttgagacagagtcttgctctgtcacccaggatggcgtgcagtggcgcggtcttggctcactgcaacctccgcctcccgggttcaagcggttctcctgccacctcagactcccaagtagctggtattacaggcacccgccactatgccggctagttttttgtgtttttagtagagacggggtttctccatgatggcctggctagtctcgaactcctgacctcaagtgattcacctgcctcggcctcccacagtgctgggattacaggcgtgagccaccacacccatcctcacattactttcatgatggttatcttctaagatttccattataaaatacagagtgtggtgagcattcttgtacatacatcttacatacttgtgcaaatatatatgtaggttaaattctaagatgtggaattgcaaagtttgtaaagtgtgtagttttcatttgataaacttaaaaaatcaatatcaaaattaaagtcataattttatattgataaggccctggtgaattataaaatcaaacttatttttcgtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303851 - DNA, 3820 bp, Homo sapiens
tagcaactccaagctgctcacaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacctgtaataccagaactttgggaggccgaggtgggtggatcacgaggtcagaagttcaagaccagcctggctaagttggtgaaaccccatctctactaaaaatacaaaaattagcggggtgcggtggcaggcacttgtaatcccagctgctcgggaggccgaggcaggagaatcgcttgaacccagtgggcagaggttgcagtgagccaagatcatgccactgcactccagcctgggtgacagagtgagactctgtctcaaaacaaaaaccttcttataattcctgtaagagcttggtaactggtagcctcctgagttgagtgctgtagggtttgaggggcaggaagagatgagttttttagtggactgatacatgagcaaaacaagattgcatgtgaaatttatactcagtgaggcatccgggcttaactcacatgctcctagtgggtatatgcactaatactacgtttgttgatacagtcttttgaaagagttgatgataagcatttcataaagtatttataaaacactggtatagcttagtgttggagagcagaagagagaattgcttgggattgtcaatgatttcttatcatctgctagaggaagacttaataacaacatcatgatgttaaggtagatctaaatgtgttaacaagaagaaaagttgaggaagtcctaagtggaaaagagaaagatgtaaattatgtagtatcatactacttacagtttttaaaaagatacatatgtttaccccaagcacattccctttttttttttttgagacagagtcttgctctgtcacccaggatggcgtgcagtggcgcggtcttggctcactgcaacctccgcctcccgggttcaagcggttctcctgccacctcagactcccaagtagctggtattacaggcacccgccactatgccggctagttttttgtgtttttagtagagacggggtttctccatgatggcctggctagtctcgaactcctgacctcaagtgattcacctgcctcggcctcccacagtgctgggattacaggcgtgagccaccacacccatcctcacattactttcatgatggttatcttctaagatttccattataaaatacagagtgtggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303852 - DNA, 3143 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303853 - DNA, 3253 bp, Homo sapiens
  misc_feature (3237)..(3237): n is a, c, g, or t
  misc_feature (3240)..(3240): n is a, c, g, or t
  misc_feature (3245)..(3245): n is a, c, g, or t
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggaaaaaaaaaaaaaaaaaaaaaaaaaaaaaaaaaaaaaaaanacnaaaanaaacaaaa

SEQ ID NO: 303854 - DNA, 3219 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggaagatgtttcatgatgatgtgtt

SEQ ID NO: 303855 - DNA, 1807 bp, Homo sapiens
ggtaaccacctatctattctttgtcttcatgaaatccaccgtgagtgaaatctcatccacttatgagtgagaacatgcagtatttgtctttctgtgcctggcttatttcactgagcatagtgacatccaggggaactgcatctttaacaacactcacgtgactgactcaggcatgtcatcatgatgtgaactccatgtgggcaggggcctagctagtatcattcactgctgtatgcctggccacatagtagacatcagtgagtgtttgctaaatggatagatgagtggtttgaaagttgaatcaggtggttctcactcacatttaccacagttctgggattgtaaaagcggtggcactgtctcatctgtttacttgtaaagcaataatattttcatattcttttagttcttcctctgtgaagaactgttgctgatctaatgtctcccagctatctggctccaggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303856 - DNA, 3201 bp, Homo sapiens
  misc_feature (3103)..(3103): n is a, c, g, or t
  misc_feature (3113)..(3113): n is a, c, g, or t
  misc_feature (3116)..(3116): n is a, c, g, or t
  misc_feature (3118)..(3118): n is a, c, g, or t
  misc_feature (3124)..(3124): n is a, c, g, or t
  misc_feature (3137)..(3138): n is a, c, g, or t
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaggtttggttaangggagtcacngananggctanggcatttaaaggnntgaatgtaaaaattgttgcgggcccaaaaaaaaaaaggggggcgcgaaataaatggggcgaaa

SEQ ID NO: 303857 - DNA, 3143 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaaccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303858 - DNA, 2889 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaatttgaggtatccgtgagggccctcacggattacctcaaacaatctgcctttacttgctgcagccaaaactaaagtcgtctagattcccctctcccatttcttcacttcttctagctccttaacaccactggtccaattctgcccaacaatttgggaaaatca

SEQ ID NO: 303859 - DNA, 2644 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagttttatgttaagtgcacaatttggccaaagaacattgctttgagagattgatggaaatcaagatgtgaagaataatctgtttactgccaagaatgttatagtgcttgtaatgtcctttccttgaagcttggcagatgtttaggaggataagtttggg

SEQ ID NO: 303860 - DNA, 930 bp, Homo sapiens
ctcaatacgtctcataagaacgtgcaagaggttacaaattagacaactgtgtcctcagggagaagctaagatctctgtctgtagactactattcgactcgtcgatcgtccaccggatgatcccacaggaggtatatctcatgtagtcgatctgcctcagtcagatctgagacctctaccgtgcagttcccttaggctaagtgacttgtctatacacccgtcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303861 - DNA, 2387 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtacaaaggttatcttttttctgtcttggtttgttattgttgttgctgttcattttagactttatttctttgatattaactatcagtcatacaaaataactgaaaagaaacaattttagtatttaactctgtcttgtattcatttctatgccagatgaatgacacgaaattcacataaaattctgctgttgtgattttttgtgcttttccagggttcttagcacgttatgtacattgcatgggtatatgcttttaatatttttatgtataaaaagtgaattacaacaactttttggaattgaaacatgggcatttttatctaagtaagtcaacaatggcataattcatataaatgaaatgagagcaataactcccaagtggttgatcttctaacattattttgtttcctagtgctgcctccatctagtacaaaacctccagctttgagtcattcaggtttagtagcttcttccttatatgtcttcttccttatatgttacaagatataaggaattcctggagaaattgccagcaataactcccaagtgtttggtccaatctacattattattttgttttccagtgtcgacttcttccactacaaaatctccagcgtccagtgcctcaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctgtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttgga

SEQ ID NO: 303862 - DNA, 1766 bp, Homo sapiens
  misc_feature (1733)..(1733): n is a, c, g, or t
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagccacggtaanccacggtcaacccacaagccacggtcaacccac

SEQ ID NO: 303863 - DNA, 2117 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtacaaaggttatcttttttctgtcttggtttgttattgttgttgctgttcattttagactttatttctttgatattaactatcagtcatacaaaataactgaaaagaaacaattttagtatttaactctgtcttgtattcatttctatgccagatgaatgacacgaaattcacataaaattctgctgttgtgattttttgtgcttttccagggttcttagcacgttatgtacattgcatgggtatatgcttttaatatttttatgtataaaaagtgaattacaacaactttttggaattgaaacatgggcatttttatctaagtaagtcaacaatggcataattcatataaatgaaatgagagcaataactcccaagtggttgatcttctaacattattttgtttcctagtgctgcctccatctagtacaaaacctccagctttgagtcattcaggtttagtagcttcttccttatatgtcttcttccttatatgttacaagatataaggaattcctggagaaattgccagcaataactcccaagtgtttggtccaatctacattattattttgttttccagtgtcgacttcttccactacaaaatctccagcgtccagtgcctcagaggtttagtaatttcctgcttatagtttttcaaaaatcctttaaattcctggtgattttttataaaatccttcaaatttctggtgatgttcacttatttttagtaatgaaaggagggaggacatttgtatagccattttagttgttatacatagtgattctaaaattatttgccataatctgatataaacaggaatatgaccttgggaaagttgtataaattttgaatgtgtttatatatatatgtttacattatatatagagaaattgatttagtaccttccttattgggtattagtaaggtataagtgggatgcatttaaagcacttagcacagtgcctggtgtagagaaagctcttagagctagccaatatgacttatcctacacttaaattaatgttagggaaggggaaggttcatgtatgtttgttagtatgtgtgtgtgttaatatgttaata

SEQ ID NO: 303864 - DNA, 1149 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccagatatcctataacctgaggaaggaactagctagacagtttgatgttttgagagtcagtttcctctgattgttaaatgc

SEQ ID NO: 303865 - DNA, 1275 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaaggtagtgtttcaatttatttccttcttcatttgtaaatactatggaaacattttgtaaatagtttcatctacagataaacaaagcaggtgtatgtgcttcctcctcctgtataattggtttctaatttattttaattcaggtcaattcaagtcaaaaaatagttctagctagagttccctatttctcacccctacatgttcttggcatttcattttatacagtgtgaactactgtgtacctgcatgagttagaagtttttgtttgaaagaaccaaaaaaaaaaaatacacactggcttaaagaaagtttcatcttgtattacaagaaatctaagagttctggctatggtagtggtaaactgtgacagactaatcgtcttcaccatccctagagtgatagctcagggccatgagtacgatcactgccctt

SEQ ID NO: 303866 - DNA, 785 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaggatttgagatcttgtgcagaactatagtgggacctgacctggacagatcattttactattgagagagacgattattgtgtgacaatcatgtggggcggctgctcccaagaaagaggcgtgtttcagagtcgatgg

SEQ ID NO: 303867 - DNA, 588 bp, Homo sapiens
acttccgccccgggggcggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattgttagaggaaat

SEQ ID NO: 303868 - DNA, 1850 bp, Homo sapiens
  misc_feature (1832)..(1832): n is a, c, g, or t
tagcaactccaagctgctcacaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacctgtaataccagaactttgggaggccgaggtgggtggatcacgaggtcagaagttcaagaccagcctggctaagttggtgaaaccccatctctactaaaaatacaaaaattagcggggtgcggtggcaggcacttgtaatcccagctgctcgggaggccgaggcaggagaatcgcttgaacccagtgggcagaggttgcagtgagccaagatcatgccactgcactccagcctgggtgacagagtgagactctgtctcaaaacaaaaaccttcttataattcctgtaagagcttggtaactggtagcctcctgagttgagtgctgtagggtttgaggggcaggaagagatgagttttttagtggactgatacatgagcaaaacaagattgcatgtgaaatttatactcagtgaggcatccgggcttaactcacatgctcctagtgggtatatgcactaatactacgtttgttgatacagtcttttgaaagagttgatgataagcatttcataaagtatttataaaacactggtatagcttagtgttggagagcagaagagagaattgcttgggattgtcaatgatttcttatcatctgctagaggaagacttaataacaacatcatgatgttaaggtagatctaaatgtgttaacaagaagaaaagttgaggaagtcctaagtggaaaagagaaagatgtaaattatgtagtatcatactacttacagtttttaaaaagatacatatgtttaccccaagcacattccctttttttttttttgagacagagtcttgctctgtcacccaggatggcgtgcagtggcgcggtcttggctcactgcaacctccgcctcccgggttcaagcggttctcctgccacctcagactcccaagtagctggtattacaggcacccgccactatgccggctagttttttgtgtttttagtagagacggggtttctccatgatggcctggctagtctcgaactcctgacctcaagtgattcacctgcctcggcctcccacagtgctgggattacaggcgtgagccaccacacccatcctcacattactttcatgatggttatcttctaagatttccattataaaatacagagtgtggtgagcattcttgtacatacatcttacatacttgtgcaaatatatatgtaggttaaattctaagatgtggaattgcaaagtttgtaaagtgtgtagttttcatttgataaacttaaaaaatcaatatcaaaattaaagtcataattttatattgataaggccctggtgaattataaaatcaaacttatttttcttatccaggatatcctcctgaggaaggtacttgacagtttggatgtttgggtcattgctgtgattgttattgccatagntgttggagttgcgttttg

SEQ ID NO: 303869 - DNA, 2236 bp, Homo sapiens
tagcaactccaagctgctcacaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacctgtaataccagaactttgggaggccgaggtgggtggatcacgaggtcagaagttcaagaccagcctggctaagttggtgaaaccccatctctactaaaaatacaaaaattagcggggtgcggtggcaggcacttgtaatcccagctgctcgggaggccgaggcaggagaatcgcttgaacccagtgggcagaggttgcagtgagccaagatcatgccactgcactccagcctgggtgacagagtgagactctgtctcaaaacaaaaaccttcttataattcctgtaagagcttggtaactggtagcctcctgagttgagtgctgtagggtttgaggggcaggaagagatgagttttttagtggactgatacatgagcaaaacaagattgcatgtgaaatttatactcagtgaggcatccgggcttaactcacatgctcctagtgggtatatgcactaatactacgtttgttgatacagtcttttgaaagagttgatgataagcatttcataaagtatttataaaacactggtatagcttagtgttggagagcagaagagagaattgcttgggattgtcaatgatttcttatcatctgctagaggaagacttaataacaacatcatgatgttaaggtagatctaaatgtgttaacaagaagaaaagttgaggaagtcctaagtggaaaagagaaagatgtaaattatgtagtatcatactacttacagtttttaaaaagatacatatgtttaccccaagcacattccctttttttttttttgagacagagtcttgctctgtcacccaggatggcgtgcagtggcgcggtcttggctcactgcaacctccgcctcccgggttcaagcggttctcctgccacctcagactcccaagtagctggtattacaggcacccgccactatgccggctagttttttgtgtttttagtagagacggggtttctccatgatggcctggctagtctcgaactcctgacctcaagtgattcacctgcctcggcctcccacagtgctgggattacaggcgtgagccaccacacccatcctcacattactttcatgatggttatcttctaagatttccattataaaatacagagtgtggtgagcattcttgtacatacatcttacatacttgtgcaaatatatatgtaggttaaattctaagatgtggaattgcaaagtttgtaaagtgtgtagttttcatttgataaacttaaaaaatcaatatcaaaattaaagtcataattttatattgataaggccctggtgaattataaaatcaaacttatttttcgtcctaggcctacttacaagcctccagtctcaaattatccaggatatcctaaacctgaggaaggaatacttgacagtttgggttggtatagctatcatgacaaatataagtggtagtatgtgtagaaacgtgtaggtaattagtttttatgaggtgcccaaacataggatccttggtagggtaagataactttcttaaatgctgtgtttgtatgtaggttaaaatatataaaacacaattttctttccacattatattgttattttgtgatggtaatctgtcgataaattttctttctattcatatcttatatacatgaaccttaaagcaatctaagttgggtttattttttctgtaacacgctgatttaacacacttgatgtaggcttacgcagtttacacaatgcatgttaaaaaaaaagatgaagtgcagttgtgatataggccaatgaaaaataaagatttcttaataagtaaaaacaa

SEQ ID NO: 303870 - DNA, 1444 bp, Homo sapiens
tagcaactccaagctgctcacaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacctgtaataccagaactttgggaggccgaggtgggtggatcacgaggtcagaagttcaagaccagcctggctaagttggtgaaaccccatctctactaaaaatacaaaaattagcggggtgcggtggcaggcacttgtaatcccagctgctcgggaggccgaggcaggagaatcgcttgaacccagtgggcagaggttgcagtgagccaagatcatgccactgcactccagcctgggtgacagagtgagactctgtctcaaaacaaaaaccttcttataattcctgtaagagcttggtaactggtagcctcctgagttgagtgctgtagggtttgaggggcaggaagagatgagttttttagtggactgatacatgagcaaaacaagattgcatgtgaaatttatactcagtgaggcatccgggcttaactcacatgctcctagtgggtatatgcactaatactacgtttgttgatacagtcttttgaaagagttgatgataagcatttcataaagtatttataaaacactggtatagcttagtgttggagagcagaagagagaattgcttgggattgtcaatgatttcttatcatctgctagaggaagacttaataacaacatcatgatgttaaggtagatctaaatgtgttaacaagaagaaaagttgaggaagtcctaagtggaaaagagaaagatgtaaattatgtagtatcatactacttacagtttttaaaaagatacatatgtttaccccaagcacattccctttttttttttttgagacagagtcttgctctgtcacccaggatggcgttgcagtgagccaagatcatgccactgcactccagcctgggtgacagagtgagactctgtctcaaaacaaaaccttcttataattcctgtaagagcttggtaactggtagcctcctgagttgagtgctgtaggtttgaggggcaggaagagatgagttttttagtggacggatacatgacacgactgagtcca

SEQ ID NO: 303871 - DNA, 429 bp, Homo sapiens
tggccgtccgcaaagtgctcagatacagccatgcagaacgcgtgactaacatatacacggacacgcacgagagcagggccacgcccacctgtcctgcagcactggatgctttatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattgttagaggaaat

SEQ ID NO: 303872 - DNA, 345 bp, Homo sapiens
atagcaaagagtctggatggaatataaatgtgtaggtgcttaaataacatttgaccactgaaatgtaaccaacatttatttcttctgctagatgttgaatcttggtgattagttttcagaattatatgtcatttgtttcctggtttcttatagttgttggagttgcagtaatttgtgttgtcccgtacagatatcttcaaaggaggaagaagaaagggtaaattaaagcatgtttcttttaacttcttggtccttcttatacttaacatgcttttgtgcagcttcagtttgtaatctgtattgcatgctatctttttttttttaaaaaaaaatgcctgcattagt

SEQ ID NO: 303873 - DNA, 857 bp, Homo sapiens
gcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaaggtaagaaagccctgggcttcctttccaggaagaagcaaggaggcagttttctctgagagactggcccagcagcagagctgaagtgcctggggaatcaccttccagagcagaaagcacaggtagtccaacatgatttcaagaaaattcacaattctcctgaggaataagatgattcctctctcaatatgatggcttggtttggctgagagtttagttcagctcgagatgtttcatttggtgcagtatgtgtctgttgaaaatttttattttttttgaaatggagcctgggtgacagagtgaaactgtctcaaa

SEQ ID NO: 303874 - DNA, 775 bp, Homo sapiens
gcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaaggtaagaaagccctgggcttcctttccaggaagaagcaaggaggcagttttctctgagagactggcccagcagcagagctgaagtgcctggggaatcaccttccagagcagaaagcacaggtagtccaacatgatttcaagaaaattcacaattctcctgaggaataagatgattcctctctcaatatgatggcttggtttgctgaggtcatgccactgcactccagcctg

SEQ ID NO: 303875 - DNA, 686 bp, Homo sapiens
ccagatgcagctcaagcagagcacgtgcgagcgggtgatgatcctgcgttcccgatttctggatgcgcggcggaagagacggaatttcaacaagcaagcgacagaaatcctgaatgaataggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttttggggccttcgtgtccgaggccagcacaccaagaccactggccgccgtggccgcaccgtgggtgtgtccaagaagaaataagtctgtaggccttgtctgttaataaatagtttatatac

SEQ ID NO: 303876 - DNA, 6091 bp, Homo sapiens
gaattcccttttctgggcaccgccttctgctagggggttgtagatgaaagtgcctgctcccagagaagcttgtctaacctagcacagtttctaagctacccaggctgccagaccgagcgaccgtgctgccatggacacagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303877 - DNA, 6088 bp, Homo sapiens
  misc_feature (5906)..(5906): n is a, c, g, or t
gaattcccttttctgggcaccgccttctgctagggggttgtagatgaaagtgcctgctcccagagaagcttgtctaacctagcacagtttctaagctacccaggctgccagaccgagcgaccgtgctgccatggacacagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacactcncctttcccccctcaccccgtgtagtggtgccctctggggacatgcggagtgggggtcttatccctgtgctgagcccttagggcagacaggatggcatgttttaggggaggggtaagccttcctccctatttgtcgtcagtgttattcctaataaaatgggtatttgctctatgcaaaatgcc

SEQ ID NO: 303878 - DNA, 6055 bp, Homo sapiens
gaattcccttttctgggcaccgccttctgctagggggttgtagatgaaagtgcctgctcccagagaagcttgtctaacctagcacagtttctaagctacccaggctgccagaccgagcgaccgtgctgccatggacacagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcgcagcatctggccgtccactggtttcagctgtgtcccccagtccgtgtttttttagaaatgggattgtgattaaatttgtgaaataaaggtttctatctactttgtaaaaaaaataatattgtaatttaaagactcgagggggggccctgtacccaattcgccctataatgagctcctttactcc

SEQ ID NO: 303879 - DNA, 6496 bp, Homo sapiens
gcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303880 - DNA, 5728 bp, Homo sapiens
gaattcccttttctgggcaccgccttctgctagggggttgtagatgaaagtgcctgctcccagagaagcttgtctaacctagcacagtttctaagctacccaggctgccagaccgagcgaccgtgctgccatggacacagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggacatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303881 - DNA, 6126 bp, Homo sapiens
gcggccgcgcggagcccgccatgccggcgcgggtctgaggcgtggcgagccagggccgaggcgagcggcgggcgcgccgcccctgtcgccccgcggcggcccggcccgggcccgatgagcggcggcctcggcctccggcgcagcccggaaatgtccggcaagatcgagaaagcagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303882 - DNA, 6012 bp, Homo sapiens
gcggccgcgcggagcccgccatgccggcgcgggtctgaggcgtggcgagccagggccgaggcgagcggcgggcgcgccgcccctgtcgccccgcggcggcccggcccgggcccgatgagcggcggcctcggcctccggcgcagcccggaaatgtccggcaagatcgagaaagcagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaaaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303883 - DNA, 5557 bp, Homo sapiens
ggattataggtgtgagccactgcgcccggcctggagcattttagagaacccttagatcattttcagatgaggaaattgaggtgcaaagttgggggcacagccaagctccagtagctcattagcaaccaaaccagaaccccagggttctatatccagggagcctgctcttcagccccacctcacccactgtgttcttcctggtcacgtcctcaccctctcagggcctgtgtgtgctctgtcccgcctttgaccttctgtaaccccaagttcttcccaattctccagcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303884 - DNA, 4348 bp, Homo sapiens
  misc_feature (4)..(4): n is a, c, g, or t
ggcnccagatcctccgcggacgtccggccgttcatcaccctcctgcttgagcgtcagcctggacataatttcgttgtggtcaatgagggacagctcgctcacttccttctcctctgtctcccactgtgtccagcaaactaaagtggccttcacccccgaggacggcagtgccgctcagggcctcagtgtgtccgtctctaactcctttctcagccggcacggcagcttgcccgtgccctcggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303885 - DNA, 5071 bp, Homo sapiens
  misc_feature (4987)..(4987): n is a, c, g, or t
  misc_feature (5025)..(5025): n is a, c, g, or t
gaattcccttttctgggcaccgccttctgctagggggttgtagatgaaagtgcctgctcccagagaagcttgtctaacctagcacagtttctaagctacccaggctgccagaccgagcgaccgtgctgccatggacacagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtctgtnccgacaagatggcggacggggagctgaacgtggacagnctcatcacccggctgctggaggtacgaggatgtcgtccaggaaaga

SEQ ID NO: 303886 - DNA, 5656 bp, Homo sapiens
gcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcaagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303887 - DNA, 4160 bp, Homo sapiens
ctgggaccagagttggcctcagctcccacagcacggttctccaggcagcaccatcatcggtagaaagtgcccatgagataaaaccctttcctgtttcccctctctgatctgccgtttcctttgagagatggacagagaggacgtgtgacttctctgggacatgcaggcggagacaccagagggggttcccaagccctcggctccctcgcccatcccactccccgtgccatctcccctgcctctctcagagcaaggactcaaatccaccctggctaccaccccccagcactctgcacccagacaagcagtttgcattgtttttccctctagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303888 - DNA, 4436 bp, Homo sapiens
ggggtgctttgtggttgcacggctctgctctcaggtgtcaggacctgcatgggagaaggtcaggtcagccttggcctcaggcttcagcttagatcctgtctatcccttgacaactgtgtgccaagcctgtcacttagccccggagcttccgattccttaggaggaaaatgagggacaatttcggggccttttagggctgtcacaaagaccaggtgagccagggcgcacagagtcttcaggaccgcatcgagagtcctgtgatctctagaggggtggcacagcactgcccgtcccagaagccaggcgctgtcccatctgccataattccagggcacagcagatgggggagggctctggaattgggcagacatgggcgccgaccccgccacattgcttgcgggtggtgtggcctcgtgcctgggctcctcctctctcggtagggtaacagactctgtccttgtgggattgctctgggcattgaaggatgtggcatatgttcaaggcatggcccagtgctcaccagcgagtcccacgaagttgtcatggctactggcaatgatgcacccgcaaaggccagttgacttgggccccttcttccagaagcagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303889 - DNA, 3620 bp, Homo sapiens
tgccatttactccatggctgtgaaagtcgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303890 - DNA, 6363 bp, Homo sapiens
  misc_feature (4511)..(4511): n is a, c, g, or t
gcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatcctttccttcctgacccagggcccctgcaccatgggcattttggagagagagggaccctcttgcccttcagtcctcgtgggggaagccgagcagcatattgggtggcagtgtgattgaagtagggacacaggagccccatggaccgaggttcccacctctaccctcccgcattccagctttgagctcaggcaagttcctcatctctaaaagggccgagtgaaatgatgtgaagaggctggaacatagtctgggaatgtgtgtctggtggcagttgtggtcattggatgactctaaaaacgaattagacatgccccagactgggaggggtaaatgtgccggtcctgcagacgcctcggagagaccctcatggtcggctccggcagcttctcagagctgagccccagggcgttgggcacgaaggataccaagacccaaaaagacagctcaggggtcagcacagtcaccttccctggagcggaccctgcgactgccacatccacaactggaatgggctcctgtccccagatctaccccatgggcccaccctcagtaaatgtcaccctctgcagtagtggctgaggaggaccccaggggtttggaaggacccacttgtgtgacccattgcctcttcaagtccaaacctgcccatcctaagaggctgacctgcagctgctgctctaggagggtagcctgggtcagctgctcctcagccacctctttgcacatagcccacggctgccatctgctgggcagccaccaccacctggggtaggaagtcctgagtccacccgcgcccccgctccttcctgtgtgccctgagccttcactgctccactcagggcctcctgcagacctcctggcctcctattctcccctcgtgttgacctttagaatccctgatctatcaagacagacgtggacatcctccattggcggagcctcgggtccccggcaagttctgttactcagagcacctgctcacaggcctgactcagtgaatggctgtcactcacacgtgtcaaggacttgctggtcaggcgagatgtgctttacacctgtgctttcacctagccctagctctatgaccattttttaatatgtgtgtgtgggtgtgtataaaattaccatattatacatggggccactgctctataactccctattgtgtaattgaggaaaccgaggcccagagacatgaaggacctgacccatgtggctgcttggtgggagagcagccacacgctgcttgccccctgctgcctgcgcccaggctctcagcctctgcctggctcagccatcatggaaatattgcagcatcaaggtctgggcctggttggctggcgacccctgtgctgtgggccaagacacagtccctggtacgttgctctgtcctgagccccatgacttggaaggtcgtggatcactagagagcaggcaggagggtgtcagagagatctggggagtcgatggcgagcacaacagccgggcaggaaaccctgaccacaaagcagagcccgacctcagggcatgagctagagctgatcgggtgcttgaagtgctgccctggagacagggagccaatgtggagcgtgctgcagctctgggaagagagacccggcccggtgtcacggaggtgagagttcccttgcagagcccagggaggcagcctcaggatggaaactcacagaaagactggagggagatacttctggcctacacacctgcctagggacctggggtttggagggtgtttgntttgggcccaccgttctctacctaaagttcagcaaggcactctctacgtgtctgtaatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303891 - DNA, 3046 bp, Homo sapiens
cgcttcacctaggtggaaagcgacgtgcatcccgtatctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303892 - DNA, 2886 bp, Homo sapiens
  misc_feature (68)..(68): n is a, c, g, or t
  misc_feature (90)..(90): n is a, c, g, or t
  misc_feature (1034)..(1034): n is a, c, g, or t
tgacagaagagatcctgaagctgctgagcttgacaatctgggcaaggcttgtgggatgctgtttccancctcctcgtcaaaaccattctngcccctgagccttcactgctccactcagggcctcctgcagacctcctggcctcctattctcccctcgtgttgacctttagaatccctgatctatcaagacagacgtggacatcctccattggcggagcctcgggtccccggcaagttctgttactcagagcacctgctcacaggcctgactcagtgaatggctgtcactcacacgtgtcaaggacttgctggtcaggcgagatgtgctttacacctgtgctttcacctagccctagctctatgaccattttttaatatgtgtgtgtgggtgtgtataaaattaccatattatacatggggccactgctctataactccctattgtgtaattgaggaaaccgaggcccagagacatgaaggacctgacccatgtggctgcttggtgggagagcagccacacgctgcttgccccctgctgcctgcgcccaggctctcagcctctgcctggctcagccatcatggaaatattgcagcatcaaggtctgggcctggttggctggcgacccctgtgctgtgggccaagacacagtccctggtacgttgctctgtcctgagccccatgacttggaaggtcgtggatcactagagagcaggcaggagggtgtcagagagatctggggagtcgatggcgagcacaacagccgggcaggaaaccctgaccacaaagcagagcccgacctcagggcatgagctagagctgatcgggtgcttgaagtgctgccctggagacagggagccaatgtggagcgtgctgcagctctgggaagagagacccggcccggtgtcacggaggtgagagttcccttgcagagcccagggaggcagcctcaggatggaaactcacagaaagactggagggagatacttctggcctacacacctgcctagggacctggggtttggagggtgtttgntttgggcccaccgttctctacctaaagttcagcaaggcactctctacgtgtctgtaatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgggggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303893 - DNA, 6000 bp, Homo sapiens
  misc_feature (4511)..(4511): n is a, c, g, or t
gcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatcctttccttcctgacccagggcccctgcaccatgggcattttggagagagagggaccctcttgcccttcagtcctcgtgggggaagccgagcagcatattgggtggcagtgtgattgaagtagggacacaggagccccatggaccgaggttcccacctctaccctcccgcattccagctttgagctcaggcaagttcctcatctctaaaagggccgagtgaaatgatgtgaagaggctggaacatagtctgggaatgtgtgtctggtggcagttgtggtcattggatgactctaaaaacgaattagacatgccccagactgggaggggtaaatgtgccggtcctgcagacgcctcggagagaccctcatggtcggctccggcagcttctcagagctgagccccagggcgttgggcacgaaggataccaagacccaaaaagacagctcaggggtcagcacagtcaccttccctggagcggaccctgcgactgccacatccacaactggaatgggctcctgtccccagatctaccccatgggcccaccctcagtaaatgtcaccctctgcagtagtggctgaggaggaccccaggggtttggaaggacccacttgtgtgacccattgcctcttcaagtccaaacctgcccatcctaagaggctgacctgcagctgctgctctaggagggtagcctgggtcagctgctcctcagccacctctttgcacatagcccacggctgccatctgctgggcagccaccaccacctggggtaggaagtcctgagtccacccgcgcccccgctccttcctgtgtgccctgagccttcactgctccactcagggcctcctgcagacctcctggcctcctattctcccctcgtgttgacctttagaatccctgatctatcaagacagacgtggacatcctccattggcggagcctcgggtccccggcaagttctgttactcagagcacctgctcacaggcctgactcagtgaatggctgtcactcacacgtgtcaaggacttgctggtcaggcgagatgtgctttacacctgtgctttcacctagccctagctctatgaccattttttaatatgtgtgtgtgggtgtgtataaaattaccatattatacatggggccactgctctataactccctattgtgtaattgaggaaaccgaggcccagagacatgaaggacctgacccatgtggctgcttggtgggagagcagccacacgctgcttgccccctgctgcctgcgcccaggctctcagcctctgcctggctcagccatcatggaaatattgcagcatcaaggtctgggcctggttggctggcgacccctgtgctgtgggccaagacacagtccctggtacgttgctctgtcctgagccccatgacttggaaggtcgtggatcactagagagcaggcaggagggtgtcagagagatctggggagtcgatggcgagcacaacagccgggcaggaaaccctgaccacaaagcagagcccgacctcagggcatgagctagagctgatcgggtgcttgaagtgctgccctggagacagggagccaatgtggagcgtgctgcagctctgggaagagagacccggcccggtgtcacggaggtgagagttcccttgcagagcccagggaggcagcctcaggatggaaactcacagaaagactggagggagatacttctggcctacacacctgcctagggacctggggtttggagggtgtttgntttgggcccaccgttctctacctaaagttcagcaaggcactctctacgtgtctgtaatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcattgggacatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 303894 - DNA, 4502 bp, Homo sapiens
gcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgcataggcaagcaccggaagcaccccggcggccgc

SEQ ID NO: 303895 - DNA, 3661 bp, Homo sapiens
gcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacacctacctctctctgggcttctatttcgaccgcgatgatgtggctctggaaggcgtgagccacttcttccgcgaactggccgaggagaagcgcgagggctacgagcgtctcctgaagatg

SEQ ID NO: 303896 - DNA, 3028 bp, Homo sapiens
gcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgaagagcatggaggccgagatgatccagttgcaggaggaactggcaccgcggagcagtgccaagcagccaggcccagcaggagcgggatgagctggctgacgagatcgccatcagcagcggcaaagtacctggcggtagagaggaggagat

SEQ ID NO: 303897 - DNA, 3061 bp, Homo sapiens
gcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggaggtgagaacttcccgggctggggctttgcagcctggccccacagaggagagcaggtggggcagagaagaatgtgatcttgtcataagcagaacaaccctaggaggcttagagaccaagtctttcaatgcccctggtgagcctctgggctgtgggctctggaggggtagactccaggggaagtgtgctgtctccttctgatgcttatagaaagtcatcttacacaggtcaagttctgcagcctctctagctaaagatgccagaactcctgagggtgtggagatggaacccctgtaaatgctctgcagacagagcctgcatgtggccggccctcactaatgggaaactttttctgtggttgaaaaaatagctccactgtagcttcagtctgggagacagaggcaggggaatggcttgagtccaggcgttcaagaccagcctgggcaacacagcaagacccatctctaaaaaaaa

SEQ ID NO: 303898 - DNA, 347 bp, Homo sapiens
gtgagttgctccctgctgttctttacttggaaacgcgtgaacagggccgttccttggaagcgtgtgcctcagccatgtgttctgctgcccgtcgcggcccctgcccttctgcgggtccctacacctagatgggaaggctatgaatggttggttctctggggccttaaagaccatgaggcatccaggtgaggcaggggcaggcatgggaaatgtgagtggccaccttgggagcatcaccagtctggcataaactgacagagacattttagcctttttatcccaatctcgctttggaccttggatcagccctctgtgttccaggattaaaaaggaatatagccaggtgt

SEQ ID NO: 303899 - DNA, 664 bp, Homo sapiens
tgtttctcctggcctcacctgcttccagcaatatgagtttgtgcgatttgtatgttccctccctggggattgagctttcagtgcatcatacctacttcgtagcattccatgggcgggacctttggtgtccttgtaaaataagaaccattaggatggtgagtgtttgccacgttagccaagctcagttggctaagacagttctccttttccagctgtgtcatcctctgggcatttaaaacagctcagcacatcatgtccacaccccaggctgctgcctccctgccctgcagttccctacgttgccttggcgcacactcaaacacagggaactctgtgatgtccagaacatccatcatttggctttagggcctgtgctctgaaacatgcaaaccccttgagacacagccaaagatgtcctcaagagttagtggcctcagcagggccagtcaagccagatatgttgaaacagctattgactttcatcaacccctcccttcggcctcaaacagccatttcaaactctgtaggaatccaggtttcctctcttccaggaggcaacagacagatttctaccagagggctaccctctccccttggatctggagcagcaggcagtagaatttatgtccaccagtgctgtggcttccaggtctcaaaggcagaa

SEQ ID NO: 303900 - DNA, 549 bp, Homo sapiens
ctggtcacgtcctcaccctctcagggcctgtgtgtgctctgtcccgcctttgaccttctgtaaccccaagttcttcccaattctccagcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataataggtaattaccttcctatttgtccagtgcctcccatggcagaatgagaaagaaagggaggaagacagggctcgggccctttcccctcagcgctgagggcttggccccccttgggaggctgactctggagctgtccccaccccgccggccctcgctggccaccctgagctctcctgaaggcctccttgtgccctcagcccagggagacatggtatgatttattatgaaagaaaaagaaagggttgttcttttttgttcatttggtatttacaggttttattttggcggaggggagtaggcaggagttgaag

SEQ ID NO: 303901 - DNA, 372 bp, Homo sapiens
tgggatcacctggggccccctccctgtgagcagcccagcctcagggccctgtttgtgctccatgtgctggtggcaccgtctctgagcactggtgtcccctctgtcacattggtcaacggtagcccctgcagcatccgtttgctgcgaggctgtggggatggtccccgcggcaccttccaggagggtggcgccatcgggccatccagcccacacaggtgctcactgactgctccccatcccctgcaccaggcactatgacatgcggaggaacgacgacattataaacttcttcaatgacttcagtgaccacctggctgaggaggccctatgggaactgtctctgaaaattaaacccaggaacataacaaggag

SEQ ID NO: 303902 - DNA, 4692 bp, Homo sapiens
ggcgtcgccgcaagagcgcgagaggcgcggcgggaggagccggcggcgcgcgcctccctgggcccggactcggccccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303903 - DNA, 472 bp, Homo sapiens
gttgtgggtcgggcttccgtgtggacggcagcactttcatttctctccttctgttggcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatcca

SEQ ID NO: 303904 - DNA, 1330 bp, Homo sapiens
agtccggatagcagcgccgaggtctgctcgtggtgagagaccccgagtcccggcacactgtgggggggccgcaggacggcggcccggggtgccctcgggacccctgcgctccgagactcgaggactacgcgacaaacggcagttcaggctgccgcgggtgcaggtttgctcatccacggccgccgggttagggagacgattctggcacgttccaggcaggccggtgtcgggagagggtccctgcgtgtgggagacggaggcggcggggtcggctggagaaccggggaaggaacgcggcggcctcctcccgcgggaagaggcccaagccgggctcgccctgcggctcagcgaggagcccgccctgccggcttctgaggacgcgccccggaccctgctctcctgggcctgaggtgacacgttctgtcgattgaggccccgaggtttgcggaagtctctggccgcagccgcgggaggcgcaacacgctgaggctgcgcgacgtggggcccgcccggacccgcctccgcccgtgtctccccgcagccgtctctgccagaactatcggaagagaccggaactgttggttttgtgtctgtgagaagagcagcactgggaataagtcacctgctgagctgacagcggaaacgaaggacaagcggagtcgcctagcgccgtcgctgcttagcccagaaaacggcctcgtcagcgccctcgacctgtttgcggaccgcttcaggagctgaaggaaccaccgagatgaccactcccgggtcctgctgaaggcggagaacagccacagccactcagactacatcaacgctagccccatcctcttctcaattctggtcttcagggaaggatgaggacatctcactaaaattccaaatttgcctttaatcaaacatggtgcctgcaggatgcaatgctgttctagggctgagtgagacggggcaggtgatcgaggcacaaatcgcaccctacggtgtcccaaagtttctttgctcgtccatagggagctttggatgaaagtattggcccaactgcctgcaggccacggccactgatggcggacagtgctcagctctcggctctgctgatctcagcagccactgatggtggagggtgctcagctctcggctctgctggtctcagcggccactgatgacggacggtgctcagctctcagctctgctggtctcagtggccactgatggcagatggcgctcagctctcagctctgctggtctcagcggtcactgatggtggagggtgctcagctctcagctctgctggtctcagtggccactgatggcagacagtgctcagctctcg

SEQ ID NO: 303905 - DNA, 758 bp, Homo sapiens
ggcgtcgccgcaagagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacggtggtgccgagtcccacaaaggaacctggaatccagctgagtgggcacgtgctgcctgtcacggcccttcatgtcctgaacatctgttgagaggaggcgggggtgtcaccttaattccatcttggacaccacagtgacacaaagtgcaaagtgccgtgcccctcatccccacagatatgtggcatcccactggtctcctaaccacccaacgccgttgctcctgaccattggaaacgctggtggggctggagcacctggacagtccagtctcgttctagtggctggactggagtggggttgccttgaacccgtcttaggctggaaatgcccccagcagcagtgccaggggaactctcactggggcctgccctgggagccccggggaacacttgtcagttcagctctgaccttaaggtgggactgccccatgcccttggcccaggagtgggagctgcaggaggag

SEQ ID NO: 303906 - DNA, 696 bp, Homo sapiens
cgccccatcctcagtcagagtcccagcatccgccgcacctgcctgtcccttctcccttctcccctttattgtattttcactgaaggctgagaggagccagtctccacacggtgggccacttgcgattcccacagccccgtccgcactgcactgtttgtcttgttgctggaaactcagccccctgcgccccgaggaaggaaggcggctggtggaggacgtcgcccgcctcctgcaggtgcccagcagtgcgttcgctgacgtggacagtatacagacaacccaaagagtgagaaaaaatcttcatgatctatatatccgacaaaagactaatatccagactctacaaagaactcacattagcaagaaacaaacagtcccatcaaacaatgggctaaagacatgaatagacaattcttgaaagaagatatacaaatggccaacaaacatatgaaaaaatgcccaacatcactaatgatcagggaaatgcaaatcgaaaccacaatgttataccaccttactcctgcaagattggatataatcaaaaaatcaaaaaacagtagatgctggtgtggatgtggtgaacagggaacacttctacactgctggtgggagtgcaaactagcacagccactatggaaaacagtgtggagattccttaaagaactaaaagaactaccatttgattcagcaatccca

SEQ ID NO: 303907 - DNA, 4838 bp, Homo sapiens
ggcgtcgccgcaagagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303908 - DNA, 4787 bp, Homo sapiens
ggcgtcgccgcaagagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctggatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303909 - DNA, 4751 bp, Homo sapiens
ggcgtcgccgcaagagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303910 - DNA, 4724 bp, Homo sapiens
ggcgtcgccgcaagagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303911 - DNA, 4037 bp, Homo sapiens
ggcgtcgccgcaagagcgcgagaggcgcggcgggaggagccggcggcgcgcgcctccctgggcccggactcggccccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctactgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303912 - DNA, 3608 bp, Homo sapiens
ggcactccggagtctcctcttctgaatacaggaagactagggtgctcggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303913 - DNA, 3116 bp, Homo sapiens
agtccggatagcagcgccgaggtctgctcgtggtgagagaccccgagtcccggcacactgtgggggggccgcaggacggcggcccggggtgccctcgggacccctgcgctccgagactcgaggactacgcgacaaacggcagttcaggctgccgcgggtgcaggtttgctcatccacggccgccgggttagggagacgattctggcacgttccaggcaggccggtgtcgggagagggtccctgcgtgtgggagacggaggcggcggggtcggctggagaaccggggaaggaacgcggcggcctcctcccgcgggaagaggcccaagccgggctcgccctgcggctcagcgaggagcccgccctgccggcttctgaggacgcgccccggaccctgctctcctgggcctgaggtgacacgttctgtcgattgaggccccgaggtttgcggaagtctctggccgcagccgcgggaggcgcaacacgctgaggctgcgcgacgtggggcccgcccggacccgcctccgcccgtgtctccccgcagccgtctctgccagaactatcggaagagaccggaactgttggttttgtgtctgtgagaagagcagcactgggaataagtcacctgctgagctgacagcggaaacgaaggacaagcggagtcgcctagcgccgtcgctgcttagcccagaaaacggcctcgtcagcgccctcgacctgtttgcggaccgcttcaggagctgaaggaaccaccgagatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303914 - DNA, 4774 bp, Homo sapiens
  misc_feature (3324)..(3324): n is a, c, g, or t
  misc_feature (3365)..(3365): n is a, c, g, or t
ggcgtcgccgcaagagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttaggtgaacgccatcctcaaggcccttccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaacaggaagaacaaatctgggcattgagcaagctatgagggtccccgggagcacacgaaccctgccaggcccccgctggctcctccaggcacgtcccggactgtggggccccagagaggggacatttccctcctgggagagaaggagatcaggncaactcggagagggctgcgagcatttccctcccgggaaganatcagggcgacctgcacgcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303915 - DNA, 1929 bp, Homo sapiens
gttgtgggtcgggcttccgtgtggacggcagcactttcatttctctccttctgttggcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303916 - DNA, 2114 bp, Homo sapiens
caactctgacacagtcaaacgcttagttcattttgttctggcaaaatttaccacatctttggccaaagaggggggaacaagcaagagggagtcacatctgagcacagcagctcatcccacaagctacaagctgctcagaggctcgaagcccccaggggcctcccttctcccctcacttggattctcccagcccgcgtccttcctccccctctcacatccgccatcctttcctctcgccggccccctgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303917 - DNA, 4697 bp, Homo sapiens
ggcgtcgccgcaagagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303918 - DNA, 4134 bp, Homo sapiens
ggcgtcgccgcaagagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagcagtttgagttcgcgctgacagccgtggctgaggaggtgaacgccatcctcaaggcccttccccagtgagcggcagcctcaggggcctcaggggagcccccaccccacggatgttgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303919 - DNA, 4420 bp, Homo sapiens
ggcgtcgccgcaagagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcggggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303920 - DNA, 3381 bp, Homo sapiens
ggcgtcgccgcaagagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacgatggagtgtttggaaggtgccagaaggttccggcaatggacttttaccgctacgaggtgtcgcccgtggccctgcagcgcctgcgcgtggcgttgcagaagctttccggcacaggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcagatggtgtgggagagcggctgcgtggtgatcgtcatgctgacacccctcgcggagaacggcgtccggcagtgctaccactactggccggatgaaggctccaatctctaccacatctatgaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcagaaaagtaaacaagtgctacaggggccgttcttgtccaataattgttcattgcagtgacggtgcaggccggagcggcacctacgtcctgatcgacatggttctcaacaagatggccaaaggtgctaaagagattgatatcgcagcgaccctggagcacttgagggaccagagacccggcatggtccagacgaaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatcca

SEQ ID NO: 303921 - DNA, 978 bp, Homo sapiens
gctgctcgggggcatctgttttcataacgtagaaatcaatattttaacattaaaaacacatctcaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaggatgatcacatggaaggcggcgcagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcaca

SEQ ID NO: 303922 - DNA, 2657 bp, Homo sapiens
ggcgtcgccgcaagagcgcgagaggcgcggcgggaggagccggcggcgcgcgcctccctgggcccggactcggccgcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggctgcctgctcgaggagggcctctgcggagcgtccgaggcctgtgtgaacggtttcacgtggcaggatgactatactcagtatgtgatggaccaggaacttgcagacctcccgaaaacctacctgaggcgtcctgaagcatccagcccagccaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgagggtgatgaccgcttctccgagagcatcctgacctatgtggcccacacgtctgcgctgacctaccctcccgggccccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccagatgacggagtgcaggacgacgatgatagactttaccaagaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagaccccctgcgccccgaggaaggaaggcggctggtggaggacgtcgcccgcctcctgcaggtgcccagcagtgcgttcgctgacgtggaggttctcggaccagcagtgaccttcaaagtgagcgccaatgtccaaaacgtgaccactgaggatgtggagaaggccacagttgacaacaaagacaaactggaggaaacctctggactgaaaattcttcaaaccggagtcgggtcgaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctgtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctatgaccactcccgggtcctgctgaaggcggagaacagccacagccactcagactacatcaacgctagccccatcatggatcacgacccgaggaaccccgcgtacatcgccacccagggaccgctgcccgccaccgtggctgacttttggcaggtgaacatttttaaattaaaatctctctttctgaaaagaagatctcaataactgggtcacgaatcatgtcttgaatctgattaggccaatcaaacttcttacaaatgctcatcaaatgttacttatatcagaatttcagtctg

SEQ ID NO: 303923 - DNA, 467 bp, Homo sapiens
attttgttctggcaaaatttaccacatctttggccaaagaggggggaacaagcaagagggagtcacatctgagcacagcagctcatcccacaagctacaagctgctcagaggctcgaagcccccaggggcctcccttctcccctcacttggattctcccagcccgcgtccttcctccccctctcacatccgccatcctttcctctcgccggcccccgtaagcaggaaggaaatgaactgtcactagctttgttgtgggtcgggcttccgtgtggacggcagcactttcatttctctccttctgttggcagtgacggtgcaggccggagcggcacctacgtcctgatcgacatggttctcaacaagatggccaaaggtgagacacagacactgccgctttgttgcggctcagagctgggatggcgtcgctatggcaacgtagggtgccgtgttcacgggaggccctgg

SEQ ID NO: 303924 - DNA, 600 bp, Homo sapiens
aggggtcccacactgctgggctataggccctggaggctgtttgggagtcccacactgctgtgtgatggaccctggaggctgggcaggggtcctgtgctgctgggtggggggccctggaggccaagtgggggtctcacactgctgggtgggccaatgttcctctgacccctgcactgtgtccttgcagatgaccactcccgggtcctgctgaaggcggagaacagccacagccactcagactacatcaacgctagccccatcgtaagtgcactgccgggacaggggccccaggctttcccttgggtggcacggacgcggcaaatcacgtgggaaggttctcgggggaaatcacgtccccacccagctcagcgtctctgcggtggacagggccgactctgcccattgggctcccgccactcccctgttccttcaccagcggggctgtttatgagccgtgtgggtcccggctcacgctgggcggtgggttccgtgacttgtagaacatccagcaatggtgactggacagtttcctgactagaagacatggcttttaggagaggttcgtagtgggtgccgttcctctttcctggagctacacat

SEQ ID NO: 303925 - DNA, 511 bp, Homo sapiens
ggggtgcgttgaccgtcatgttgcgctggcctgccctggggtaaactctcgcctgcctgaaccttggatcttagcaggagaaggggttgtgccacgtgggtgccgtggccctcgtcctgctgggtgtccccaatgccactaaccccctgctcttcctccccctgtcctgcaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctggtaagcccagtctttgcactccctgccacacaaacaccagggccctccttcctcggcccctgcaacacccagcatctgcgcccgctgaccctcggggactgggcgatgatggctgcaccctgcccgctgcagaggctgacaggc

SEQ ID NO: 303926 - DNA, 2369 bp, Homo sapiens
gctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtctccctgacttggtcccagaccccaactatgtgcaagcatccacttatgtgcagagagcccacctgtactccctgcgctgtgctgcggaggagaagtgtctggccagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacaggtcgctacgtttctgcaacaaactgcaaaattgtccaatcctgatctccgggagggacagatggccaatctctccccttccaaagcaggccctgctccccgggcagcctcccgccgaggggcccagcccccaacccacaggcagggaggggcatccctccctgccggcctcagggagcgaacgtggatgaaaaccacagggattccggatgccagaccccattttatacttcacttttctctacagtgttgttttgttgttgttggtttttattttttatactttggccataccacagagctagattgcccaggtctgggctgaataaaacaaggtttttctac

SEQ ID NO: 303927 - DNA, 1534 bp, Homo sapiens
gctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcgtaactcctgctcagactcctgcatgcccagggaggaaggtggaggggcaggaacaggacggacaggccccgggctctggcacatcctg

SEQ ID NO: 303928 - DNA, 671 bp, Homo sapiens
  misc_feature (468)..(468): n is a, c, g, or t
tttttttttgttgttttgacttgaaaacgacacattttattatttcaagtttctgtggttcaggaatccaggtgtggtttagccaagtcttctggctcaaagtctcttacaagggtaaaagtaaggggtcagccaaggctctggtgtcatctgaaggctcaactggggaaggatttgcttctaagttccctcacatggctgctggcagcatgtggttcctcaccagttgttggactgtgggcctcagctcctggcttgctgttggccagccaccaccctcggttctctgccacatgggttttccataaggtggctcacaacacagcagcttcccattccaaccagtgggttgacatttccacctctaagtgaaactggcaatctgactgcaggcccaggatccaggtccagtcctgagggagacaaggtcctaacaggggagggacccaccgctccggaacagagagngtatcttgcggagtgggggacaaagtcttgacctcctcttcatccaggcaggcaggagctcctgccggtgcgcagctccgacacgcccccgccgggtggggagcggaacggcgcgcagcagggccgcctcagcgtgggcagcgtgtaccggcccaaccagaacggccgcggtgagtacggccccggcgcccctccggccgcgc

SEQ ID NO: 303929 - DNA, 1308 bp, Homo sapiens
  misc_feature (215)..(215): n is a, c, g, or t
gatcattcatcaagtggtacacttaggatttgtggacttttgtgtgtgtgtatgctatactcatgtttttaaaagttatttttggccgggcacggctgtcacgcctgtaagcccagcactttgggaggccgaggtgggcagatcatgaggtcaggagatcaagaccatcctggctaacatgggaaatcccgtctcaccgctccggaacagagagngtatcttgcggagtgggggacaaagtcttgacctcctcttcatccaggcaggcaggagctcctgccggtgcgcagctccgacacgcccccgccgggtggggagcggaacggcgcgcagcagggccgcctcagcgtgggcagcgtgtaccggcccaaccagaacggccgcggtctccctgacttggtcccagaccccaactatgtgcaagcatccacttatgtgcagagagcccacctgtactccctgcgctgtgctgcggaggagaagtgtctggccagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacaggtcgctacgtttctgcaacaaactgcaaaattgtccaatcctgatctccgggagggacagatggccaatctctccccttccaaagcaggccctgctccccgggcagcctcccgccgaggggcccagcccccaacccacaggcagggaggggcatccctccctgccggcctcagggagcgaacgtggatgaaaaccacagggattccggatgccagaccccattttatacttcacttttctctacagtgttgttttgttgttgttggtttttattttttatactttggccataccacagagctagattgcccaggtctgggctgaataaaacaaggtttttctac

SEQ ID NO: 303930 - DNA, 2491 bp, Homo sapiens
gctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtctccctgacttggtcccagaccccaactatgtgcaagcatccacttatgtgcagagagcccacctgtactccctgcgctgtgctgcggaggagaagtgtctggccagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacaggtcgctacgtttctgcaacaaactgcaaaattgtccagcaggcagctgggccagcgtgcacaggaagctggacagagcgttcccagaaaggccacgggactgacgcctgtgggtttccatcgtgtttctggaggaaaaaggaggcttaaaaaaaaaaaaatcctgatctccgggagggacagatggccaatctctccccttccaaagcaggccctgctccccgggcagcctcccgccgaggggcccagcccccaacccacaggcagggaggggcatccctccctgccggcctcagggagcgaacgtggatgaaaaccacagggattccggatgccagaccccattttatacttcacttttctctacagtgttgttttgttgttgttggtttttattttttatactttggccataccacagagctagattgcccaggtctgggctgaataaaacaaggtttttctac

SEQ ID NO: 303931 - DNA, 2477 bp, Homo sapiens
gctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtctccctgacttggtcccagaccccaactatgtgcaagcatccacttatgtgcagagagcccacctgtactccctgcgctgtgctgcggaggagaagtgtctggccagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacaggtcgctacgtttctgcaacaaactgcaaaattgtccaatcctgatctccgggagggacagatggccaatctctccccttccaaagcaggccaccgactacgatgtgcgggtgctactgcgcttcccccagcgcgtgaagaaccagggcacagcagacttcctccccaaccggccacggcacacctgggagtggcacagctgccaccagcattaccacagcatggacgagttcagcccccaacccacaggcagggaggggcatccctccctgccggcctcagggagcgaacgtggatgaaaaccacagggattccggatgccagaccccattttatacttcacttttctctacagtgttgttttgttgttgttggtttttattttttatactttggccataccacagagctagattgcccaggtctgggctgaataaaacaaggtttttctac

SEQ ID NO: 303932 - DNA, 2332 bp, Homo sapiens
gctcccagcctgttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtctccctgacttggtcccagaccccaactatgtgcaagcatccacttatgtgcagagagcccacctgtactccctgcgctgtgctgcggaggagaagtgtctggccagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacagatcctgatctccgggagggacagatggccaatctctccccttccaaagcaggccctgctccccgggcagcctcccgccgaggggcccagcccccaacccacaggcagggaggggcatccctccctgccggcctcagggagcgaacgtggatgaaaaccacagggattccggatgccagaccccattttatacttcacttttctctacagtgttgttttgttgttgttggtttttattttttatactttggccataccacagagctagattgcccaggtctgggctgaataaaacaaggtttttctac

SEQ ID NO: 303933 - DNA, 632 bp, Homo sapiens
cagggtcaggggagaaacccaggggaaggtgggccagaaactcctgaaggtgggcgtggggtggctctgggaaacaagcagcatcacagccgctcctcttgtccctttcccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacaggtcgctacgtttctgcaacaaactgcaaaattgtccaatcctgatctccgggagggacagatggccaatctctccccttccaaagcaggccctgctccccgggcagcctcccgccgaggggcccagcccccaacccacaggcagggaggggcatccctccctgccggcctcagggagcgaacgtggatgaaaaccacagggattccggatgccagaccccattttatacttcacttttctctacagtgttgttttgttgttgttggtttttattttttatactttggccataccacagagctagattgcccaggtctgggctgaataaaacaaggtttttctac

SEQ ID NO: 303934 - DNA, 361 bp, Homo sapiens
agcatccacttatgtgcagagagcccacctgtactccctgcgctgtgctgcggaggagaagtgtctggccaggtaaggagctgaggcagaagtgtagagtgttgggatagtccccgggagtcacccagaacccagcctagctgtggctgccagctaggctgtctgcaagctgatgaccctggccaagtgccccagcctcccaggaccctgaccgtttcatcagtgagccttgcctgccccgagggagtcaggaggggaggggagcaagcgggggcccagcatttctgtatactgtacctcactatacaaggaactccacttttactgtggcacttcatctttatatgagccctgaaggcat

SEQ ID NO: 303935 - DNA, 3784 bp, Homo sapiens
gaaaattgttcattcaattgtgtcatcctttgcagttggaatatttggagttttcctgatcttgttggatgtggctctgatctttgctgacctaattttcactgatagcaaagtttatattcctttggagtatcattctatttctctagctattgctttattttttctcatggatgttcttcttcgagtatttgtagaagggagacagcattatttttctgatttacttaacattttagatactgctgttactgtgattattctgctggttgatgtcgtttacattttttttgacgttaagtttcttaaggatattcccagatggacacgtttatttcgacttctacgacttatcattctgataagagtttttcatctggctcatctaaaaagacaacttggaaagctgataagaaggctggtttcaggaaacaaaaggtgatacgaaagtgatggatttgacctagacctcacttatattacagaacatattgtcgctatgtcgtttccatcttcgggaggccagtctttctatcggaatccaattaaggaagtcatacagtttctagacaaagaaacatccaaaccactatcgagtctacaatctatgcagtgaaagagcttatgatcctaagcacttccataatagggtcagtagaatcatgatcgatgatcataatgtccccactctacgggagatggtagcattctccaaggaagtgttggagtggatggctcaagattctgaaaacatcgtagtgattcactgtaaaggaggcaaaggaagaaccggaactatggtttgtgcctgcctgattgccagtgaaatatttttaactgcagaggaaagattgtactattttggagaacggcgaacagataaaaccaatggcactaaatatcagggagtagaaactccttctcagaatagatatgttggatattttgcacaagtgaaacatagctacaactggaatctccctccaagaaaaacactgtttataaaaagattcgttatttattcgattcatggtgttggaacaggcgatggatatgatctaaaagtccaaatagtaatgaagaaaaagattgtcttttcctgtacttccttaaagaattgtcgggtatttcatgacactgaaacagacagggtaataactgatgtgttcaactgtccacctctgtatgatgatgtgaaagtgcaagcttcctcttcagacaaaaaataatatccaaagatattttggcactaacagcgctatctgtagcaagaaagttgagcagtgtgaactgttgagacttccaagaagacttcagagaaccaagacagtgtaaaggaaaacaggaaaaaagacttgttagacattattaagggcacgaaagttgaattgagcacagtaaatgtacaaacaacaaagccacccaacagaagtccacttaaaagctacaactggcccgcctcaaagagctacagagcatgctccaaagaagagaaatgagcccgtgagtcctgagttggtggcagctgcatctgctgctctgttttgacaagcaaacaagccagaactgctcaggcagctccgtagcatgaggaagagtcaggggcacagagagatggagagagacctagttagagagcgaaccatgtgctggatttagccagtcctgcatttttctatacttcaaatcaaaacgggccatgcttcacatctacccatgatgaataggggtactttgattaagaataaatagagctgactgaattctgaacaagaaaaacatattcaaggggaagagatgtaatagttttgacgtgacgacagttactaaagaagcacctgaacagacacatcaccttcactttgggatgtggaatttgctaaataagccacagaaaatgaacatcccttcagaatgggtttgaagagctgatccagtggattaaagaggggaaactgggagtttccaattaacaatgaagcaggagctgactaaggctttggaacagaaaccagatgatgcacaatattattgtcaaagagcttattgtcacattcttcttgggagttactatggatctgtaaataactgacgaaaaacccatctgtttctacgtagttgctgttgccgacacaaagaagtcttatgaactcaatccaaataattccactgctatgctgagaaaagggggctggcggcatggagtcttgctctgtcacccatcctcgagtgcaatggcaccatcttagttcactgcagccttgaattccagggctcgagccatccttctgcctctgcctcctgagtaggtgggactacaggcatgtgccaccatactgagctaatttgttaaacactttttttgtagagacgaggtcttgctacgtttcccagactggtctctgaactcccggcctcaagtgatcctactgccttggcctcccaaagtactggcataatagacatgagccactgcacctggctcctaagttcttttcttgaataatatctttctttttttttattttttgaggtggagtctcaccctgttgcccaggctggagtgcaatggcgtgatctcggctcactgcaacttctacctcccgggttcaagtgattctcctgcctcagcctcctgaatagctaggattacaggcgtgcgctaccacgcctggctaattttttgtgtctttagtagagatgcggtttcaccatgttggccaggcttgtctcgaactcttgacctcgtgatccacccgccttggcctcccaaagtgttgggattacaggcgtgagccaccacgcctggccaagtaatatcttaatatcatgccattgacatttatcctctaattatttcagaggtggccttcagaagaaggcctctttggtaaaattgctattgaggatatttcactgaaaaacaaatttatctttaaatttaaatccaggaaaaatttaaactttcaggcttctatttttatcagacagggtaaaaaatttataactcagaatattaccctttcccctctttgtgtgatggattgcttggttttagttactgattatttaaaataataagttattcaaatctaggattttgatacaatagttcttctctagaatatagtgtgtgtgtgagagtatatttaaaatttttattaaggcccatggggcagcctttgaggaaaccagaccttggggatcgccaggcaggattagtggcaggaattgagagaacagagccccacagagctcctcggggaccgtcccccagtcacaagagtatctcaaggaagtagtcttctcccacatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagcttaacacagctggggtctgctactcgcgttttgtagacttttgtgtaactatttgtaccgtaggacagaatgtgaggaggaagtaacacacacagaggaggatgtgtgtgtgtgcatgtgtttgaattcacaaggaagaaattatttatcttgagctttttcctttgttattcagtttttattggtttattactaataatgataataaaatgtaaacaagagcaaa

SEQ ID NO: 303936 - DNA, 3496 bp, Homo sapiens
  misc_feature (411)..(411): n is a, c, g, or t
  misc_feature (616)..(616): n is a, c, g, or t
agaccggaaacggaggagagcgcgggggatgtgtttggcatggggacgcactgttacagttgcgctcctggttggctttgtgtttccgcggtgttggtagagtctcggtgtttctacctcttagcaccctttcctgccaccctttgtcctgtggaagcccggagacatcagcggctgcaattttgctactcgctgctcggcatggaacggtcaggtaccgcagttcagcgctcttggccccgcaggtcctcgggcatccccgtgccccgtgctgtacattcagttatcctccgacttcccggggtcgaaggtattacctgctgggttttagaatctattgctttacatctgagaaaagaaaaatcccagaaagataagatgacttgcccaagatcatagcgtgcctggaanacagtgctccgattacaagctggtcgctgtgcctcattcgtcttgtcatcaactcctgtcagtttatccaagctccaaaagcgaagttgttttagcttttgcttcccaagatttatttgatagtctcatttctgtttccttcgtttattctttcgttcattattggaaaactttacagcgtgccagtactggtcataaaccccantgtgtcttaggccttagtgagctgtgaggtgcatgaccttaggtaagttacttctctgattttcagtttccttatctgcaaaatggagaccttagggagttaatgtgggtatgagaaatgtacataaaacatattgcacaaggtgaggcatgtagtgtatgctaataaatggtaagttgctgctgctatggttgttaacaataattataaaaagcaaatggaaaaggcttgaattgaaaaaaatttagacacatagtttttttccttattagcctgcactgtatttttcattttttttaatgcatctttccaggacaaaaaataatatccaaagatattttggcactaacagcgctatctgtagcaagaaagttgagcagtgtgaactgttgagacttccaagaagacttcagagaaccaagacagtgtaaaggaaaacaggaaaaaagacttgttagacattattaagggcacgaaagttgaattgagcacagtaaatgtacaaacaacaaagccacccaacagaagtccacttaaaagctacaactggcccgcctcaaagagctacagagcatgctccaaagaagagaaatgagcccgtgagtcctgagttggtggcagctgcatctgctgctctgttttgacaagcaaacaagccagaactgctcaggcagctccgtagcatgaggaagagtcaggggcacagagagatggagagagacctagttagagagcgaaccatgtgctggatttagccagtcctgcatttttctatacttcaaatcaaaacgggccatgcttcacatctacccatgatgaataggggtactttgattaagaataaatagagctgactgaattctgaacaagaaaaacatattcaaggggaagagatgtaatagttttgacgtgacgacagttactaaagaagcacctgaacagacacatcaccttcactttgggatgtggaatttgctaaataagccacagaaaatgaacatcccttcagaatgggtttgaagagctgatccagtggattaaagaggggaaactgggagtttccaattaacaatgaagcaggagctgactaaggctttggaacagaaaccagatgatgcacaatattattgtcaaagagcttattgtcacattcttcttgggagttactatggatctgtaaataactgacgaaaaacccatctgtttctacgtagttgctgttgccgacacaaagaagtcttatgaactcaatccaaataattccactgctatgctgagaaaagggggctggcggcatggagtcttgctctgtcacccatcctcgagtgcaatggcaccatcttagttcactgcagccttgaattccagggctcgagccatccttctgcctctgcctcctgagtaggtgggactacaggcatgtgccaccatactgagctaatttgttaaacactttttttgtagagacgaggtcttgctacgtttcccagactggtctctgaactcccggcctcaagtgatcctactgccttggcctcccaaagtactggcataatagacatgagccactgcacctggctcctaagttcttttcttgaataatatctttctttttttttattttttgaggtggagtctcaccctgttgcccaggctggagtgcaatggcgtgatctcggctcactgcaacttctacctcccgggttcaagtgattctcctgcctcagcctcctgaatagctaggattacaggcgtgcgctaccacgcctggctaattttttgtgtctttagtagagatgcggtttcaccatgttggccaggcttgtctcgaactcttgacctcgtgatccacccgccttggcctcccaaagtgttgggattacaggcgtgagccaccacgcctggccaagtaatatcttaatatcatgccattgacatttatcctctaattatttcagaggtggccttcagaagaaggcctctttggtaaaattgctattgaggatatttcactgaaaaacaaatttatctttaaatttaaatccaggaaaaatttaaactttcaggcttctatttttatcagacagggtaaaaaatttataactcagaatattaccctttcccctctttgtgtgatggattgcttggttttagttactgattatttaaaataataagttattcaaatctaggattttgatacaatagttcttctctagaatatagtgtgtgtgtgagagtatatttaaaatttttattaaggcccatggggcagcctttgaggaaaccagaccttggggatcgccaggcaggattagtggcaggaattgagagaacagagccccacagagctcctcggggaccgtcccccagtcacaagagtatctcaaggaagtagtcttctcccacatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagcttaacacagctggggtctgctactcgcgttttgtagacttttgtgtaactatttgtaccgtaggacagaatgtgaggaggaagtaacacacacagaggaggatgtgtgtgtgtgcatgtgtttgaattcacaaggaagaaattatttatcttgagctttttcctttgttattcagtttttattggtttattactaataatgataataaaatgtaaacaagagcaaa

SEQ ID NO: 303937 - DNA, 788 bp, Homo sapiens
agaccggaaacggaggagagcgcgggggatgtgtttggcatggggacgcactgttacagttgcgctcctggttggctttgtgtttccgcggtgttggtagagtctcggtgtttctacctcttagcaccctttcctgccaccctttgtcctgtggaagcccggagacatcagcggctgcaattttgctactcgctgctcggcatggaacggtcaggacaaaaaataatatccaaagatattttggcactaacagcgctatctgtagcaagaaagttgagcagtgtgaactgttgagacttccaagaagacttcagagaaccaagacagtgtaaaggaaaacaggaaaaaagacttgttagacattattaagggcacgaaagttgaattgagcacagtaaatgtacaaacaacaaagccacccaacagaagtccacttaaaagctacaactggcccgcctcaaagagctacagagcatgctccaaagaagagaaatgagcccgtgagtcctgagttggtggcagctgcatctgctgctctgttttgacaagcaaacaagccagaactgctcaggcagctccgtagcatgaggaagagtcaggggcacagagagatggagagagacctagttagagagcgaaccatgtgctggatttagccagtcctgcatttttctatacttcaaatcaaaacgggccatgcttcacatctacccatgatgaataggggtactttgattaagaataaatagagctgactgaattctgaacaagtgagtattttgtgagaa

SEQ ID NO: 303938 - DNA, 610 bp, Homo sapiens
cccccagccttgctgctgccttgcagtttgatctcagactgctgtgctagcaatcagcgagactccgtgggcgtaggaccctccaagccaggtgaaagagcttatgatcctaagcacttccataatagggtcagtagaatcatgatcgatgatcataatgtccccactctacgggagatggtagcattctccaaggaagtgttggagtggatggctcaagattctgaaaacatcgtagtgattcactgtaaaggaggcaaagaatagatatgttggatattttgcacaagtgaaacatagctacaactggaatctccctccaagaaaaacactgtttataaaaagattcgttatttattcgattcatggtgttggaacaggcgatggatatgatctaaaagtccaaatagtaatgaagaaaaagattgtcttttcctgtacttccttaaagaattgtcgggtatttcatgacactgaaacagacagggtaataactgatgtgttcaactgtccacctctgtatgatgatgtgaaagtgcaagcttcctcttcaagagaagagggcagcacacctcgcagggctaactggaagggggagccatccaggaga

SEQ ID NO: 303939 - DNA, 2781 bp, Homo sapiens
agaccggaaacggaggagagcgcgggggatgtgtttggcatggggacgcactgttacagttgcgctcctggttggctttgtgtttccgcggtgttggtagagtctcggtgtttctacctcttagcaccctttcctgccaccctttgtcctgtggaagcccggagacatcagcggctgcaattttgctactcgctgctcggcatggaacggtcaggacaaaaaataatatccaaagatattttggcactaacagcgctatctgtagcaagaaagttgagcagtgtgaactgttgagacttccaagaagacttcagagaaccaagacagtgtaaaggaaaacaggaaaaaagacttgttagacattattaagggcacgaaagttgaattgagcacagtaaatgtacaaacaacaaagccacccaacagaagtccacttaaaagctacaactggcccgcctcaaagagctacagagcatgctccaaagaagagaaatgagcccgtgagtcctgagttggtggcagctgcatctgctgctctgttttgacaagcaaacaagccagaactgctcaggcagctccgtagcatgaggaagagtcaggggcacagagagatggagagagacctagttagagagcgaaccatgtgctggatttagccagtcctgcatttttctatacttcaaatcaaaacgggccatgcttcacatctacccatgatgaataggggtactttgattaagaataaatagagctgactgaattctgaacaagaaaaacatattcaaggggaagagatgtaatagttttgacgtgacgacagttactaaagaagcacctgaacagacacatcaccttcactttgggatgtggaatttgctaaataagccacagaaaatgaacatcccttcagaatgggtttgaagagctgatccagtggattaaagaggggaaactgggagtttccaattaacaatgaagcaggagctgactaaggctttggaacagaaaccagatgatgcacaatattattgtcaaagagcttattgtcacattcttcttgggagttactatggatctgtaaataactgacgaaaaacccatctgtttctacgtagttgctgttgccgacacaaagaagtcttatgaactcaatccaaataattccactgctatgctgagaaaagggggctggcggcatggagtcttgctctgtcacccatcctcgagtgcaatggcaccatcttagttcactgcagccttgaattccagggctcgagccatccttctgcctctgcctcctgagtaggtgggactacaggcatgtgccaccatactgagctaatttgttaaacactttttttgtagagacgaggtcttgctacgtttcccagactggtctctgaactcccggcctcaagtgatcctactgccttggcctcccaaagtactggcataatagacatgagccactgcacctggctcctaagttcttttcttgaataatatctttctttttttttattttttgaggtggagtctcaccctgttgcccaggctggagtgcaatggcgtgatctcggctcactgcaacttctacctcccgggttcaagtgattctcctgcctcagcctcctgaatagctaggattacaggcgtgcgctaccacgcctggctaattttttgtgtctttagtagagatgcggtttcaccatgttggccaggcttgtctcgaactcttgacctcgtgatccacccgccttggcctcccaaagtgttgggattacaggcgtgagccaccacgcctggccaagtaatatcttaatatcatgccattgacatttatcctctaattatttcagaggtggccttcagaagaaggcctctttggtaaaattgctattgaggatatttcactgaaaaacaaatttatctttaaatttaaatccaggaaaaatttaaactttcaggcttctatttttatcagacagggtaaaaaatttataactcagaatattaccctttcccctctttgtgtgatggattgcttggttttagttactgattatttaaaataataagttattcaaatctaggattttgatacaatagttcttctctagaatatagtgtgtgtgtgagagtatatttaaaatttttattaaggcccatggggcagcctttgaggaaaccagaccttggggatcgccaggcaggattagtggcaggaattgagagaacagagccccacagagctcctcggggaccgtcccccagtcacaagagtatctcaaggaagtagtcttctcccacatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagcttaacacagctggggtctgctactcgcgttttgtagacttttgtgtaactatttgtaccgtaggacagaatgtgaggaggaagtaacacacacagaggaggatgtgtgtgtgtgcatgtgtttgaattcacaaggaagaaattatttatcttgagctttttcctttgttattcagtttttattggtttattactaataatgataataaaatgtaaacaagagcaaa

SEQ ID NO: 303940 - DNA, 2911 bp, Homo sapiens
agaccggaaacggaggagagcgcgggggatgtgtttggcatggggacgcactgttacagttgcgctcctggttggctttgtgtttccgcggtgttggtagagtctcggtgtttctacctcttagcaccctttcctgccaccctttgtcctgtggaagcccggagacatcagcggctgcaattttgctactcgctgctcggcatggaacggtcaggacaaaaaataatatccaaagatattttggcactaacagcgctatctgtagcaagaaagttgagcagtgtgaactgttgagacttccaagaagacttcagagaaccaagacagtgtaaaggaaaacaggaaaaaagacttgttagacattattaagggcacgaaagttgaattgagcacagtaaatgtacaaacaacaaagccacccaacagaagtccacttaaaagctacaactggcccgcctcaaagagctacagagcatgctccaaagaagagaaatgagcccgtgagtcctgagttggtggcagctgcatctgctgctctgttttgacaagcaaacaagccagaactgctcaggcagctccgtagcatgaggaagagtcaggggcacagagagatggagagagacctagttagagagcgaaccatgtgctggatttagccagtcctgcatttttctatacttcaaatcaaaacgggccatgcttcacatctacccatgatgaataggggtactttgattaagaataaatagagctgactgaattctgaacaagaaaaacatattcaaggggaagagatgtaatagttttgacgtgacgacagttactaaagaagcacctgaacagacacatcaccttcactttgggatgtggaatttgctaaataagccacagaaaatgaacatcccttcagaatgggtttgaagagctgatccagtggattaaagaggggaaactgggagtttccaattaacaatgaagcaggagctgactaaggctttggaacagaaaccagatgatgcacaatattattgtcaaagagcttattgtcacattcttcttgggagttactatggatctgtaaataactgacgaaaaacccatctgtttctacgtagttgctgttgccgacacaaagaagtcttatgaactcaatccaaataattccactgctatgctgagaaaagggggctggcggcatggagtcttgctctgtcacccatcctcgagtgcaatggcaccatcttagttcactgcagccttgaattccagggctcgagccatccttctgcctctgcctcctgagtaggtgggactacaggcatgtgccaccatactgagctaatttgttaaacactttttttgtagagacgaggtcttgctacgtttcccagactggtctctgaactcccggcctcaagtgatcctactgccttggcctcccaaagtactggcataatagacatgagccactgcacctggctcctaagttcttttcttgaataatatctttctttttttttattttttgaggtggagtctcaccctgttgcccaggctggagtgcaatggcgtgatctcggctcactgcaacttctacctcccgggttcaagtgattctcctgcctcagcctcctgaatagctaggattacaggcgtgcgctaccacgcctggctaattttttgtgtctttagtagagatgcggtttcaccatgttggccaggcttgtctcgaactcttgacctcgtgatccacccgccttggcctcccaaagtgttgggattacaggcgtgagccaccacgcctggccaagtaatatcttaatatcatgccattgacatttatcctctaattatttcagaggtggccttcagaagaaggcctctttggtaaaattgctattgaggatatttcactgaaaaacaaatttatctttaaatttaaatccaggaaaaatttaaactttcaggcttctatttttatcagacagggtaaaaaatttataactcagaatattaccctttcccctctttgtgtgatggattgcttggttttagttactgattatttaaaataataagttattcaaatctaggattttgatacaatagttcttctctagaatatagtgtgtgtgtgagagtatatttaaaatttttattaaggcccatggggcagcctttgaggaaaccagaccttggggatcgccaggcaggattagtggcaggaattgagagaacagagccccacagagctcctcggggaccgtcccccagtcacaagagtatctcaaggaagtagtcttctcccacatcccccaaagataactaccagagggtcagttctctgagcccttctcagtgtagaaaagacaagtgtcaaagcttccccactcaccctgagtttgccttctatgacaatacgtcgtttggcctcactgaggctgagcagaggatgctggacctcccaggatattttgggtcaaatgaagaggatgaaaccacaagtacacttagcgtggagaagctggtgatctagactgagaatcagcctgagcttaacacagctggggtctgctactcgcgttttgtagacttttgtgtaactatttgtaccgtaggacagaatgtgaggaggaagtaacacacacagaggaggatgtgtgtgtgtgcatgtgtttgaattcacaaggaagaaattatttatcttgagctttttcctttgttattcagtttttattggtttattactaataatgataataaaatgtaaacaagagcaaaaaaaaaaaaaaaaatcggaaggatccattgccgggtgggaaaaaggggttatgacggggcacgtggccaaagttgttcctgacccagtttttttgttccaagtgctaaatcggcgggctcccctataggg

SEQ ID NO: 303941 - DNA, 559 bp, Homo sapiens
atgatacattataaaaatttataagtaaagtttgttaagaggaaagattatgcttatattttaggggaagggggaatattgaactacatttatagtgattttgtttcaggtttttctgaggaattttaaataccctgtgtcctcttaatagtaaaaacagtttgaggtactctgagtttcttacaactatttgtctctgaatagttttctcttaaaatttgacaaatattaaaaacattgtccttccttctttggttacagtggagtctcttctgttttgccaggaaagttaacatatttttttttccatttttgttcatcatttacaaattagatggtatagattttagcaaatagatctcaagagctggattcaattagcagctttttaggacataaacattaaagggttagatggaaaagattgttttgactgactggataaatgacagggctgtgtttgatgtgcgtccaggaattggtctggagctggtgcccaacttctcagtccatcttgagaagccaaataaaatacttaacctaggcctcattttgttta

SEQ ID NO: 303942 - DNA, 1150 bp, Homo sapiens
atgatacattataaaaatttataagtaaagtttgttaagaggaaagattatgcttatattttaggggaagggggaatattgaactacatttatagtgattttgtttcaggtttttctgaggaattttaaataccctgtgtcctcttaatagtaaaaacagtttgaggtactctgagtttcttacaactatttgtctctgaatagttttctcttaaaatttgacaaatattaaaaacattgtccttccttctttggttacagtggagtctcttctgttttgccaggaaagttaacatatttttttttccatttttgttcatcatttacaaattagatggtatagattttagcaaatagatctcaagagctggattcaattagcagctttttaggacataaacattaaagggttagatggaaaagattgttttgactgactggataaatgacagggctgtgtttgatgtgcgtccaggaattggtctggagctggtgcccaacttctcagtccatcttgagaagccaaataaaatacttaacctaggcctcattttgtttaaaaaaaaaaaaaaaagttgattctttgttaagaccttaagaaatgtttggcatacctttagactaagtgtttaacagttcatttagacctgggttccctaatagaggaaaaaaaatcacttaaaaaaagacagatcccacagtgaatttatatttggtttacaatacacttgggctgtaagatgttttaaaattattgttctttgctttaagttaataccatattagtattttaaatttatagagtacctttgatttcaatatgctgtataaattttagttacttggtaataaccttattgcggaattgcctttttactgaaaggtataaacatttcttgcatggtgacacacacactcacacactcacacactcatacactgtctttctgaaatatttgaaccgtgagagctctgcccacaattgatattagacctttccacatattattcttaaacccacagtcagtgaattgtttggtatttgtcaatgctaagaaggtgggactaatttaataatttgatcccaaattttagattcctcaggcaattgggggttagaatccaatttcatccatcaagctacttctgt

SEQ ID NO: 303943 - DNA, 687 bp, Homo sapiens
ataatgggttcatattcgattggctgcacttagctataaatcctgaggaggagaagaagaaagacatcagaaagtaattggactagaagaaccttagtttggaagcaaaacacagaatccagtagagacggggtttcaccgcgttagccaggatggtctcgatctgacctcgtaatccgcccaacccagcctcccaaagtgctgggattacaggcttgagccactgcacgcagcgagaaagcaccttttaatctctaccactgccaagtacgtgagtagactggaaagaccatgggcttcagaatcaagtggccatggataaaaattgtgtctgagagactttcaaggagttacttagccattctgagctttttgctccgtgattagtatagcagtgataataatatcaaccttacaatattacgttatggaattaaatgtctgtggaagtgtcttcctcacagtaattgctcaataatgattcatgtcctcccttcccttcttaattcagatttatttacatatgctcaatagagcaataaatatttgtgattccatttttctagtacctgcttccagttatttcaggtttttatacaggcacaaaagcccttttcttctacactgctttccctaagaggagttaccttgacctaaaaaataaggaaagcaccaaccataaaaccc

SEQ ID NO: 303944 - DNA, 777 bp, Homo sapiens
ggctggataccgtggcttcacattttaggtagactgggtgttttatctactgagtgaattacagccttcggcaatgatgtcaaggtagcaacaaaacccaaaaaatccatcctttagaaattgttttaagtcacaatgatgataccttctttaaaagctttgacttactgaaataatgcttttcatttgtccaagatgagtacatagcagaatttggaaatatggttccaaaaggctaaatagactgacttttttgatatttttcccttatagggagaaagaaacattaacggtttatcagatgccttgactgtactttttactgctttgtcttcaaggcctagtgtaataattaacatctagtatgtgtttgatggatagccaatttttgcttcattggtatgttgttaccacagtcattggtagagtcaatatatgaatgaagaaagtataacaaatttgccctctagtagagtacaggcaaagtatggccgtcagtttcaccctgattttttttcctccattcttttttagggtttaggtcaagaacaagggcatttcattgtaccacatagctgagagtagggaattgggacatactgtcttgctttaaattaaagttgtctgtttcatcaagtagagaggttcctaagatattgccagatttctgactcggggtttgttaaaaatagaaaaggtagttccttaaggttgtattttattggatgcctccacctgcttcaggctagctcactggagaataaatattccaggtta

SEQ ID NO: 303945 - DNA, 1780 bp, Homo sapiens
tgtttccacacctactgagtcaggtgtcccctcagctgaagaagtatttggttccagccagccagagagaatatctcctgaaagtggacttgccaaggccatgttaaccattgctatcactgcgactccttctctgactgttgatgaaaaggaggaactccttacaagcactaactttcagcccattgtagaagagatcacagaaaccacaaaaggttttctgaagtatatggataatcaatcatttgcaactgaaagtcaggaaggagttggtttgggacattcaccttcatcctatgtgaatactaaggaaatgctaaccaccaatccaaagactgagaaatttgaagcagacacagaccacaggacaacttcttttcctggtgctgagtccacagcaggcagtgagcctggaagcctcacccctgataaggagaagccttcgcagatgacagctgataacacccaggctgctgccaccaagcaaccactcgaaacttccgagtacaccctgagtgttgagccagaaactgatagtctgctgggagccccagaagtcacagtgagtgtcagcacagctgttccagctgcctctgccttaagtgatgagtgggatgacaccaaattagagagtgtaagccggataaggacccccaagcttggagacaatgaagagactcaggtgagaacggagatgtctcagacagcacaagtaagccatgagggtatggaaggaggccagccttggacagaggctgcacaggtggctctggggctgcctgaaggggaaacacacacgggcacagccctgctaatagcgcatgggaatgagagatcacctgctttcactgatcaaagttcctttacccccacaagtctgatggaagacatgaaagtttccattgtgaacttgctccaaagtacgggagacttcacggaatccaccaaggaaaacgatgccctgtttttcttagaaaccactgtttctgtctctgtatatgagtctgaggcagaccaactgttgggaaatacaatgaaagacatcatcactcaagagatgacaacagctgttcaagagccagatgccactttatccatggtgacacaagagcaggttgctaccctcgagcttatcagagacagtggcaagactgaggaagaaaaggaggacccctctcctgtgtctgacgttcctggtgttactcagctgtcaagaagatgggagcctctggccactacaatttcaactacagtcgtccctttgtcttttgaagttactcccactgtggaagaacaaatggacacagtcacagggccaaatgaggagttcacaccagttctgggatctccagtgacacctcctggaataatggtgggggaacccagcatttcccctgcacttcctgctttggaggcatcctctgagagaagaactgttgttccatctattactcgtgttaatacagctgcctcatatggcctggaccaacttgaatctgaagagggacaagaagatgaggatgaagaggatgaagaagatgaagatgaagaagaggaagatgaggaagaagatgaggaagataaagatgcagactcgctggatgagggcttggatggtgacactgagctgccaggttttaccctccctggtatcacatcccaggaaccaggcttagaggagggaaacatggacctgttggagggagctacctaccaggtgccagatgccctcgagtgggaacagcagaatcaaggcctgggtaagagtcatgtgtatttc

SEQ ID NO: 303946 - DNA, 1055 bp, Homo sapiens
cactgtctggcactccctagtgagatgaacccggtacctcagatggaaatgcagaaatcacccgtcttctgcgtcgctcacgctgggagctgtagaccagagctgttcctattcggccatcttggctcctcccctaatgagaagctggatggaaaaattaaaagacaaggctggttacatgtctgggatgctggtgcctgtaggggttgggatagctggagccttgttcatcttgggagccctctacagcattaaggttatgaatcgccgaaggagaaatggcttcaaaaggcataaaagaaagcagagagaattcaacagcatgcaagatcgagtaatgctcttagccgacagctctgaagatgaattttgaattggactgggttttaatggggatattcaacgatgctactattctaatttttattttggagcagaaaaaaaaaaggaacaacctgccacattgctgctatcaggccgttagtcctagtgtctgctgggtgctgggtagtagatttttcttgtactgagcagaaatggcatgttgtatactaaacgtatcatgcagtatttggttttattctgtagtgaattttccacaaccgtgggctacaactcataaatatgcaacatatatgtttttcagtaggagttgctacattaggcagagtaaatattttgtagttttccacagtgtcttttccttggtttgaattacctgcattgagaataatgattgttgccaccaaggcatgcttgactctgagatataaatcttaacaaagaataacttctcaagatatactctacctacttgaaaccacagggttgtgggccatggtacatactgcatttgcatcaaactagcagtaactcagaatgaaatcattttcattaagaagctctctcagcatattaggattatatgtagatttgtatgtattttgcattatgtacttcagtctcctagttttattattctcaccttccgttttattcttggcgaggaaaaaaatgcactagaaataatacattaaactgactcttagtcttaa

SEQ ID NO: 303947 - DNA, 2678 bp, Homo sapiens
tgtttccacacctactgagtcaggtgtcccctcagctgaagaagtatttggttccagccagccagagagaatatctcctgaaagtggacttgccaaggccatgttaaccattgctatcactgcgactccttctctgactgttgatgaaaaggaggaactccttacaagcactaactttcagcccattgtagaagagatcacagaaaccacaaaaggttttctgaagtatatggataatcaatcatttgcaactgaaagtcaggaaggagttggtttgggacattcaccttcatcctatgtgaatactaaggaaatgctaaccaccaatccaaagactgagaaatttgaagcagacacagaccacaggacaacttcttttcctggtgctgagtccacagcaggcagtgagcctggaagcctcacccctgataaggagaagccttcgcagatgacagctgataacacccaggctgctgccaccaagcaaccactcgaaacttccgagtacaccctgagtgttgagccagaaactgatagtctgctgggagccccagaagtcacagtgagtgtcagcacagctgttccagctgcctctgccttaagtgatgagtgggatgacaccaaattagagagtgtaagccggataaggacccccaagcttggagacaatgaagagactcaggtgagaacggagatgtctcagacagcacaagtaagccatgagggtatggaaggaggccagccttggacagaggctgcacaggtggctctggggctgcctgaaggggaaacacacacgggcacagccctgctaatagcgcatgggaatgagagatcacctgctttcactgatcaaagttcctttacccccacaagtctgatggaagacatgaaagtttccattgtgaacttgctccaaagtacgggagacttcacggaatccaccaaggaaaacgatgccctgtttttcttagaaaccactgtttctgtctctgtatatgagtctgaggcagaccaactgttgggaaatacaatgaaagacatcatcactcaagagatgacaacagctgttcaagagccagatgccactttatccatggtgacacaagagcaggttgctaccctcgagcttatcagagacagtggcaagactgaggaagaaaaggaggacccctctcctgtgtctgacgttcctggtgttactcagctgtcaagaagatgggagcctctggccactacaatttcaactacagtcgtccctttgtcttttgaagttactcccactgtggaagaacaaatggacacagtcacagggccaaatgaggagttcacaccagttctgggatctccagtgacacctcctggaataatggtgggggaacccagcatttcccctgcacttcctgctttggaggcatcctctgagagaagaactgttgttccatctattactcgtgttaatacagctgcctcatatggcctggaccaacttgaatctgaagagggacaagaagatgaggatgaagaggatgaagaagatgaagatgaagaagaggaagatgaggaagaagatgaggaagataaagatgcagactcgctggatgagggcttggatggtgacactgagctgccaggttttaccctccctggtatcacatcccaggaaccaggcttagaggagggaaacatggacctgttggagggagctacctaccaggtgccagatgccctcgagtgggaacagcagaatcaaggcctggtgagaagctggatggaaaaattaaaagacaaggctggttacatgtctgggatgctggtgcctgtaggggttgggatagctggagccttgttcatcttgggagccctctacagcattaaggttatgaatcgccgaaggagaaatggcttcaaaaggcataaaagaaagcagagagaattcaacagcatgcaagatcgagtaatgctcttagccgacagctctgaagatgaattttgaattggactgggttttaatggggatattcaacgatgctactattctaatttttattttggagcagaaaaaaaaaaggaacaacctgccacattgctgctatcaggccgttagtcctagtgtctgctgggtgctgggtagtagatttttcttgtactgagcagaaatggcatgttgtatactaaacgtatcatgcagtatttggttttattctgtagtgaattttccacaaccgtgggctacaactcataaatatgcaacatatatgtttttcagtaggagttgctacattaggcagagtaaatattttgtagttttccacagtgtcttttccttggtttgaattacctgcattgagaataatgattgttgccaccaaggcatgcttgactctgagatataaatcttaacaaagaataacttctcaagatatactctacctacttgaaaccacagggttgtgggccatggtacatactgcatttgcatcaaactagcagtaactcagaatgaaatcattttcattaagaagctctctcagcatattaggattatatgtagatttgtatgtattttgcattatgtacttcagtctcctagttttattattctcaccttccgttttattcttggcgaggaaaaaaatgcactagaaataatacattaaactgactcttagtcttaa

SEQ ID NO: 303948 - DNA, 1809 bp, Homo sapiens
tgtttccacacctactgagtcaggtgtcccctcagctgaagaagtatttggttccagccagccagagagaatatctcctgaaagtggacttgccaaggccatgttaaccattgctatcactgcgactccttctctgactgttgatgaaaaggaggaactccttacaagcactaactttcagcccattgtagaagagatcacagaaaccacaaaaggttttctgaagtatatggataatcaatcatttgcaactgaaagtcaggaaggagttggtttgggacattcaccttcatcctatgtgaatactaaggaaatgctaaccaccaatccaaagactgagaaatttgaagcagacacagaccacaggacaacttcttttcctggtgctgagtccacagcaggcagtgagcctggaagcctcacccctgataaggagaagccttcgcagatgacagctgataacacccaggctgctgccaccaagcaaccactcgaaacttccgagtacaccctgagtgttgagccagaaactgatagtctgctgggagccccagaagtcacagtgagtgtcagcacagctgttccagctgcctctgccttaagtgatgagtgggatgacaccaaattagagagtgtaagccggataaggacccccaagcttggagacaatgaagagactcaggtgagaacggagatgtctcagacagcacaagtaagccatgagggtatggaaggaggccagccttggacagaggctgcacaggtggctctggggctgcctgaaggggaaacacacacgggcacagccctgctaatagcgcatgggaatgagagatcacctgctttcactgatcaaagttcctttacccccacaagtctgatggaagacatgaaagtttccattgtgaacttgctccaaagtacgggagacttcacggaatccaccaaggaaaacgatgccctgtttttcttagaaaccactgtttctgtctctgtatatgagtctgaggcagaccaactgttgggaaatacaatgaaagacatcatcactcaagagatgacaacagctgttcaagagccagatgccactttatccatggtgacacaagagcaggttgctaccctcgagcttatcagagacagtggcaagactgaggaagaaaaggaggacccctctcctgtgtctgacgttcctggtgttactcagctgtcaagaagatgggagcctctggccactacaatttcaactacagtcgtccctttgtcttttgaagttactcccactgtggaagaacaaatggacacagtcacagggccaaatgaggagttcacaccagttctgggatctccagtgacacctcctggaataatggtgggggaacccagcatttcccctgcacttcctgctttggaggcatcctctgagagaagaactgttgttccatctattactcgtgttaatacagctgcctcatatggcctggaccaacttgaatctgaaggtattcatgctttgaaggggatcttttcaaggactggttgagtgagtcactgagcaaatgtttttgaaaaagaattaagtaggagtatattcaatctgcagtatagatcagaggacagtaaactacagctgggccaaatctggcctgccacttgtttttgaatggtttgtaagctaagaatggtttttacattttgaaatgattgaaaaaaaaagtcaaaagaagaataatattttgtgacatagaaaagttataaaaattcaaattccagtgttcataaataaagctatattggaacacaaaaata

SEQ ID NO: 303949 - DNA, 1430 bp, Homo sapiens
acggctaggtacgaggccgggtgatgcccagcactttgggaggcctagaggggcggatcacgaggtccgatcaagaccatcctggctaacgcggtgaaaccccgcctctactaaaaatacaaaaaaattagccgggcgtggtggcacgcgcctgtagtcccagctactcaggaggctgaggcatgagaatcgcttgaacccgggaggcagagattgcagtgagccgagatcgcgccactgcactcctgcctgggcaacaagagcaaaacttcgtctcaaaaaaagaaaactggctagaatgcacttcaacttaagtcctgggagctacgctaattcatggagaaccacagaggtttaataggcatttctatacctggatcagccccaaggacagtattaccctgtactgcccttcctattactattttcagtcatttactaatattgggctgtagtactttcacgtttaagctttggctattcagagctcactacgtttaatcttcagttacctgaatggtgtttaccttctggtgtggatcatcccggcttgtgttagtgctctctctttggaagaagccaggatttaagatcgagttagcctagatgtggcccagcagggtacagaaggggaaaggctgcagaaaacgggcgtattttcgtgcaaagaggtttttgcgccatttatttatggttttcaccgtcgtatgagaggactattcatgataggctgtatttgctgacagcctactttgggctcccccatgcgttgtgccgaaaccacctctttctttcctgccttcctccgcctgggctaggaagcccagagctgcggttcgcaggcctgctaagcagccggcggccggaagtctatcccgcagaagcgcagccattcacggcctcacgcaatgcgacacttccgcctgcacgagttcttccggggcggaggtcaccatggcagctgccttggctcggcttggtctgcggcctgtcaaacaggttcgggttcagttctgtcccttcgagaaaaacgtggaatcgacgaggaccttcctgcagacggtgagcagtgagaaggtccgctccactaatctcaactgctcagtgattgcggacgtgaggcatgacggctccgagccctgcgtggacgtgctgttcggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgctaccacaa

SEQ ID NO: 303950 - DNA, 1779 bp, Homo sapiens
  misc_feature (1441)..(1441): n is a, c, g, or t
acggctaggtacgaggccgggtgatgcccagcactttgggaggcctagaggggcggatcacgaggtccgatcaagaccatcctggctaacgcggtgaaaccccgcctctactaaaaatacaaaaaaattagccgggcgtggtggcacgcgcctgtagtcccagctactcaggaggctgaggcatgagaatcgcttgaacccgggaggcagagattgcagtgagccgagatcgcgccactgcactcctgcctgggcaacaagagcaaaacttcgtctcaaaaaaagaaaactggctagaatgcacttcaacttaagtcctgggagctacgctaattcatggagaaccacagaggtttaataggcatttctatacctggatcagccccaaggacagtattaccctgtactgcccttcctattactattttcagtcatttactaatattgggctgtagtactttcacgtttaagctttggctattcagagctcactacgtttaatcttcagttacctgaatggtgtttaccttctggtgtggatcatcccggcttgtgttagtgctctctctttggaagaagccaggatttaagatcgagttagcctagatgtggcccagcagggtacagaaggggaaaggctgcagaaaacgggcgtattttcgtgcaaagaggtttttgcgccatttatttatggttttcaccgtcgtatgagaggactattcatgataggctgtatttgctgacagcctactttgggctcccccatgcgttgtgccgaaaccacctctttctttcctgccttcctccgcctgggctaggaagcccagagctgcggttcgcaggcctgctaagcagccggcggccggaagtctatcccgcagaagcgcagccattcacggcctcacgcaatgcgacacttccgcctgcacgagttcttccggggcggaggtcaccatggcagctgccttggctcggcttggtctgcggcctgtcaaacaggttcgggttcagttctgtcccttcgagaaaaacgtggaatcgacgaggaccttcctgcagacggtgagcagtgagaaggtccgctccactaatctcaactgctcagtgattgcggacgtgaggcatgacggctccgagccctgcgtggacgtgctgttcggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgctaccacaaaaaaaaaaaanaaaaaaaaaaaaaaaaagaaaaacaaaaaaaacacaaaaacacaaggggggggccgcgccccccaaaaaatatcccccgccggggggggggcccccacagtcgtcgaggcggcccacacggaagttcggtgggtgagacccaagaggggcgggcccccaacaatgagggagccgggcgaataaaacaggcccgaggcacacggcgcccgcagtgatatcaacaacaagcgggcggaggtgggggaaaacccgctggctgccagccggggggacctcttggggggagagagagcgctatatcactgcggggggggagcaccactggggggcgaggcgct

SEQ ID NO: 303951 - DNA, 1462 bp, Homo sapiens
acggctaggtacgaggccgggtgatgcccagcactttgggaggcctagaggggcggatcacgaggtccgatcaagaccatcctggctaacgcggtgaaaccccgcctctactaaaaatacaaaaaaattagccgggcgtggtggcacgcgcctgtagtcccagctactcaggaggctgaggcatgagaatcgcttgaacccgggaggcagagattgcagtgagccgagatcgcgccactgcactcctgcctgggcaacaagagcaaaacttcgtctcaaaaaaagaaaactggctagaatgcacttcaacttaagtcctgggagctacgctaattcatggagaaccacagaggtttaataggcatttctatacctggatcagccccaaggacagtattaccctgtactgcccttcctattactattttcagtcatttactaatattgggctgtagtactttcacgtttaagctttggctattcagagctcactacgtttaatcttcagttacctgaatggtgtttaccttctggtgtggatcatcccggcttgtgttagtgctctctctttggaagaagccaggatttaagatcgagttagcctagatgtggcccagcagggtacagaaggggaaaggctgcagaaaacgggcgtattttcgtgcaaagaggtttttgcgccatttatttatggttttcaccgtcgtatgagaggactattcatgataggctgtatttgctgacagcctactttgggctcccccatgcgttgtgccgaaaccacctctttctttcctgccttcctccgcctgggctaggaagcccagagctgcggttcgcaggcctgctaagcagccggcggccggaagtctatcccgcagaagcgcagccattcacggcctcacgcaatgcgacacttccgcctgcacgagttcttccggggcggaggtcaccatggcagctgccttggctcggcttggtctgcggcctgtcaaacaggttcgggttcagttctgtcccttcgagaaaaacgtggaatcgacgaggaccttcctgcagacggtgagcagtgagaaggtccgctccactaatctcaactgctcagtgattgcggacgtgaggcatgacggctccgagccctgcgtggacgtgctgttcggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgctaccacaaatgtttctggaacaagactagatcagagaggt

SEQ ID NO: 303952 - DNA, 1317 bp, Homo sapiens
acggctaggtacgaggccgggtgatgcccagcactttgggaggcctagaggggcggatcacgaggtccgatcaagaccatcctggctaacgcggtgaaaccccgcctctactaaaaatacaaaaaaattagccgggcgtggtggcacgcgcctgtagtcccagctactcaggaggctgaggcatgagaatcgcttgaacccgggaggcagagattgcagtgagccgagatcgcgccactgcactcctgcctgggcaacaagagcaaaacttcgtctcaaaaaaagaaaactggctagaatgcacttcaacttaagtcctgggagctacgctaattcatggagaaccacagaggtttaataggcatttctatacctggatcagccccaaggacagtattaccctgtactgcccttcctattactattttcagtcatttactaatattgggctgtagtactttcacgtttaagctttggctattcagagctcactacgtttaatcttcagttacctgaatggtgtttaccttctggtgtggatcatcccggcttgtgttagtgctctctctttggaagaagccaggatttaagatcgagttagcctagatgtggcccagcagggtacagaaggggaaaggctgcagaaaacgggcgtattttcgtgcaaagaggtttttgcgccatttatttatggttttcaccgtcgtatgagaggactattcatgataggctgtatttgctgacagcctactttgggctcccccatgcgttgtgccgaaaccacctctttctttcctgccttcctccgcctgggctaggaagcccagagctgcggttcgcaggcctgctaagcagccggcggccggaagtctatcccgcagaagcgcagccattcacggcctcacgcaatgcgacacttccgcctgcacgagttcttccggggcggaggtcaccatggcagctgccttggctcggcttggtctgcggcctgtcaaacaggttcgggttcagttctgtcccttcgagaaaaacgtggaatcgacgaggagacgggcatcgcctgattatgcgcggcgctcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgctaccacaa

SEQ ID NO: 303953 - DNA, 644 bp, Homo sapiens
ccccctctagagtggagccaaaacttcaagaaggcaggggtttctgtctgctttgttctctgttgtgatcagtggctgcacacagtaggtgtttagtaaatgcctgctaactgagatggacaccttactgtcattagctcatgcagaggaggggcccaaagcagggggtgatcaaggcgggtgctaagtgcaaatcccacttctgccacctactgagtgcgtgactttggaaaggggcttttgccatcttcaagtctcagtgtccccatctgcaaaatggagatgacatcaggacctggtgtggcattaatgttcacacacagaccctccaccccgacccttctaagaattctgtatttgtgggttcagggtcatggtcccccggtgccagcagtcaccttatggaggacaaaaccagcataaaccacaaggcaaaaggttaaagaaacctgttttctgacttttcccctccaattccaggatgcccttgtgcttactccagcctccttgtggaaacccacctctcctgtctcccagtgaagacttggatggcagccatcagggaaggctgggtcccagctgggagtatgggtgtgagctctatagaccatccctctctgcaatcaataaacacttgcctgtga

SEQ ID NO: 303954 - DNA, 1678 bp, Homo sapiens
tgcaggatataaggttggacttccagacccactgcccgggagaggagaggagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagctctccttcctggtgaacgccttagctaagcaggtcatgaacctcctagtgccatccctgcccaatctagtgaaaaaccagctgtgtcccgtgatcgaggcttccttcaatggcatgtatgcagacctcctgcagctggtgaaggtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccacctctcctgtctcccagtgaagacttggatggcagccatcagggaaggctgggtcccagctgggagtatgggtgtgagctctatagaccatccctctctgcaatcaataaacacttgcctgtga

SEQ ID NO: 303955 - DNA, 682 bp, Homo sapiens
  misc_feature (631)..(631): n is a, c, g, or t
  misc_feature (666)..(666): n is a, c, g, or t
  misc_feature (681)..(681): n is a, c, g, or t
tgcaggatataaggttggacttccagacccactgcccgggagaggagaggagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatggaacttggcatcaatgtgataagtntcttctgggacgcttactacaggtatgaactctangcatcttgcaattang

SEQ ID NO: 303956 - DNA, 2206 bp, Homo sapiens
tgcaggatataaggttggacttccagacccactgcccgggagaggagaggagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagctctccttcctggtgaacgccttagctaagcaggtcatgaacctcctagtgccatccctgcccaatctagtgaaaaaccagctgtgtcccgtgatcgaggcttccttcaatggcatgtatgcagacctcctgcagctggtgaaggtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccacctctcctgtctcccagtgaagacttggatggcagccatcagggaaggctgggtcccagctgggagtatgggtgtgagctctatagaccatccctctctgcaatcaataaacacttgcctgtgaaataaaaaaaaaaaaaaaaaaaaaaaaaaaaaaacaaaaaaaaaaaaaaaaaaaaaaaaaaagagagaggggggggcgcgccacaaaaagatcccccgcgggggggccccaaattagcgagcgccccccacgattttgctgcgacaaagaggggcgcccccaaaaagaggagcacgcgaatatataaaacaacgaagcagcggaggcgccgcgataaagacaaagcagcgcggagtgcaggacaacaactggtcgacgcggggacactatgcggagaacagaacacaccacaacggagagggaggggggaacaacaacaagtgggcgccaacacaatccgcccacaggagagaaaatataagagcgcacccgacgaggggccaacaataacaaacgttgcgacaagggacgatacaggcgcggtgaaaacacacacgcgacgaatactattggcgcggcggcgacgaacaaaagaatgtgctcgccaacaggcgagaatcacctagagagacacaatatattacacgc

SEQ ID NO: 303957 - DNA, 1863 bp, Homo sapiens
tgcaggatataaggttggacttccagacccactgcccgggagaggagaggagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagctctccttcctggtgaacgccttagctaagcaggtcatgaacctcctagtgccatccctgcccaatctagtgaaaaaccagctgtgtcccgtgatcgaggcttccttcaatggcatgtatgcagacctcctgcagctggtgaaggtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggcaagccatgcttctgagtgcttgaggccaccgaaatgaacaaatggaaaacactcccatctttttcaagcctaccttttagcagaagaggcagatacacaagccctaaagatgtaacatcaggctgagtggaggaaggctgagaagaaaaataaagcaggctcaggaggagagagtgatgtcaggatgcccttgtgcttactccagcctccttgtggaaacccacctctcctgtctcccagtgaagacttggatggcagccatcagggaaggctgggtcccagctgggagtatgggtgtgagctctatagaccatccctctctgcaatcaataaacacttgcctgtga

SEQ ID NO: 303958 - DNA, 1430 bp, Homo sapiens
tgcaggatataaggttggacttccagacccactgcccgggagaggagaggagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagctctccttcctggtgaacgccttagctaagcaggtcatgaacctcctagtgccatccctgcccaatctagtgaaaaaccagctgtgtcccgtgatcgaggcttccttcaatggcatgtatgcagacctcctgcagctggtgaaggtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaagcatcatcaaggaggctcacaaggaggctcacaagctgggcc

SEQ ID NO: 303959 - DNA, 937 bp, Homo sapiens
cctccaccctcacagaactttcttcttgtccttgagcagtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccacctctcctgtctcccagtgaagacttggatggcagccatcagggaaggctgggtcccagctgggagtatgggtgtgagctctatagaccatccctctctgcaatcaataaacacttgcctgtga

SEQ ID NO: 303960 - DNA, 1637 bp, Homo sapiens
tgcaggatataaggttggacttccagacccactgcccgggagaggagaggagcgggccgaggactccagcgtgcccagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagctctccttcctggtgaacgccttagctaagcaggtcatgaacctcctagtgccatccctgcccaatctagtgaaaaaccagctgtgtcccgtgatcgaggcttccttcaatggcatgtatgcagacctcctgcagctggtgaaggtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccacctctcctgtctcccagtgaagacttggatggcagccatcagggaaggctgggtcccagctgggagtatgggtgtgagctctatagaccatccctctctgcaatcaataaacacttgcctgtga

SEQ ID NO: 303961 - DNA, 1591 bp, Homo sapiens
tgcaggatataaggttggacttccagacccactgcccgggagaggagaggagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacccgcctggtcctcagtgactgtgccaccagccatgggagcctgcgcatccaactgctgcataagctctccttcctggtgaacgccttagctaagcaggtcatgaacctcctagtgccatccctgcccaatctagtgaaaaaccagctgtgtcccgtgatcgaggcttccttcaatggcatgtatgcagacctcctgcagctggtgaaggtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccacctctcctgtctcccagtgaagacttggatggcagccatcagggaaggctgggtcccagctgggagtatgggtgtgagctctatagaccatccctctctgcaatcaataaacacttgcctgtga

SEQ ID NO: 303962 - DNA, 1807 bp, Homo sapiens
cccggagataaaaccgccggcgccggcgccgccagtccctctggctgagacctcggctccggaatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggtgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggagaagaagagcggcggcgccggcaaggtcaccaagtcggcgcagaaggcgcagaaggcgggcaagtgaagcgcgggcgcccgcggcgcgaccctccccggcggcgccgcgctccgaaccccggcccggcccccgccccgcccccgccccgcgcgccgctccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgacccca

SEQ ID NO: 303963 - DNA, 239 bp, Homo sapiens
cgactggatgctcgccatcaaggtccagtggaagttcttcaagaggaaaggcgcccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgacccca

SEQ ID NO: 303964 - DNA, 519 bp, Homo sapiens
cccgttaatttacataacgggcggggtatctgaacatatcggccgtgcttctcagcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctgctttaatgaatcggaatgaagggaaaaggaagagaaaggaacagaaatacgagaaggagaacaagacgacaaaaaatgctaggagacactccaccaagaagactagcaagagaaacaaaggagaaaaaaggggaaaacaataagaagaaggaaaaaaaagaacacaagaagaagacactagatagagagacccctgaaacaaacaatacaaagcacaaaaaaagagacacgaagaaaaaacaatagagacacgcagaaa

SEQ ID NO: 303965 - DNA, 2437 bp, Homo sapiens
ctccttcccttactctaccttgctcctacttttctctaagtcaacatgagtcgacagtttagttccaggtctgggtaccgaagtggagggggcttcagctctggctctgctgggatcatcaactaccagcgcaggaccaccagcagctccacacgccgcagtggaggaggtggtgggagattttcaagctgtggtggtggtggtggtagctttggtgctggtggtggatttggaagtcggagtcttgttaaccttggtggcagtaaaagcatctccataagtgtggctagaggaggtggacgtggtagtggctttggtggtggttatggtggtggtggctttggtggtggtggctttggtggtggtggctttggtggaggtggcattgggggtggtggctttggtggttttggcagtggtggtggtggttttggtggaggtggctttgggggtggtggatatgggggtggttatggtcctgtctgccctcctggtggcatacaagaagtcactatcaaccagagccttcttcagcccctcaatgtggagattgaccctgagatccaaaaggtgaagtctcgagaaagggagcaaatcaagtcactcaacaaccaatttgcctccttcattgacaaggtgaggttcctggagcagcagaaccaggtactgcaaacaaaatgggagctgctgcagcaggtagatacctccactagaacccataatttagagccctactttgagtcattcatcaacaatctccgaaggagagtggaccaactgaagagtgatcaatctcggttggattcggaactgaagaacatgcaggacatggtggaggattaccggaacaagtatgaggatgaaatcaacaagcggacaaatgcagagaatgaatttgtgaccatcaagaaggatgtggatggtgcttatatgaccaaggtggaccttcaggccaaacttgacaacttgcagcaggaaattgatttccttacagcactctaccaagcagagttgtctcagatgcagactcaaatcagtgaaactaatgtcatcctctctatggacaacaaccgcagtctcgacctggacagcatcattgctgaggtcaaggcccagtacgaggatatagcccagaagagcaaagctgaggccgagtccttgtaccagagcaagtatgaagagctgcagatcactgctggcagacatggggatagtgtgagaaattcaaagatagaaatttctgagctgaatcgtgtgatccagagacttagatctgaaatcgacaatgtcaagaagcagatctccaacttgcagcagtccatcagtgatgcagagcagcgtggcgagaatgccctcaaggatgccaagaacaagctgaatgacctggaggatgccctgcagcaggccaaggaagacctggcccgcctgctgcgtgactaccaggagctgatgaacaccaagctggccctggatctggagattgccacctacaggaccctcctggagggagaagaaagcaggatgtctggagaatgtgccccgaacgtgagtgtgtctgtgagcacaagccacaccaccatcagtggaggtggcagccgaggaggtggcggcggtggctacggctctggaggtagcagctatggctccggaggtggtagctatggttctggaggtggcggcggcggcggccgtggcagctatggctccggaggtagcagctacggctccggaggtggcagctatggctctggaggtggcggcggcggccatggcagctacggctccggaagcagcagtgggggctacagaggtggctctggaggcggcggcggcggcagctctggcggccggggctctggcggcgggagctctggaggctccataggaggccggggatccagctctgggggtgtcaagtcctctggtggcagttccagcgtgaagtttgtttctaccacttattccggagtaaccagataaagagatgccctctgtttcattagctctagttctcccccagcatcactaacaaatatgcttggcaagaccgaggtcgatttgtcccagccttaccggagaaaagagctatggttagttacactagctcatcctattcccccagctctttcttttctgctgtttcccaatgaagttttcagatcagtggcaatctcagtcccctggctatgaccctgctttgttctttccctgagaaacagttcagcagtgaccaccacccacatgacatttcaaagcacctccttaagccagccagagtaggaccagttagacccagggtgtggacagctccttagcatcttatctctgtgctgttttggttttgtacataaggtgtaagcaagttgtttttcttttgtggagaggtcttaaactccccatttccttgttttgctgcaataaactgcatttgaaattc

SEQ ID NO: 303966 - DNA, 2416 bp, Homo sapiens
ctccttcccttactctaccttgctcctacttttctctaagtcaacatgagtcgacagtttagttccaggtctgggtaccgaagtggagggggcttcagctctggctctgctgggatcatcaactaccagcgcaggaccaccagcagctccacacgccgcagtggaggaggtggtgggagattttcaagctgtggtggtggtggtggtagctttggtgctggtggtggatttggaagtcggagtcttgttaaccttggtggcagtaaaagcatctccataagtgtggctagaggaggtggacgtggtagtggctttggtggtggttatggtggtggtggctttggtggtggtggctttggtggtggtggctttggtggaggtggcattgggggtggtggctttggtggttttggcagtggtggtggtggttttggtggaggtggctttgggggtggtggatatgggggtggttatggtcctgtctgccctcctggtggcatacaagaagtcactatcaaccagagccttcttcagcccctcaatgtggagattgaccctgagatccaaaaggtgaagtctcgagaaagggagcaaatcaagtcactcaacaaccaatttgcctccttcattgacaaggtgaggttcctggagcagcagaaccaggtactgcaaacaaaatgggagctgctgcagcaggtagatacctccactagaacccataatttagagccctactttgagtcattcatcaacaatctccgaaggagagtggaccaactgaagagtgatcaatctcggttggattcggaactgaagaacatgcaggacatggtggaggattaccggaacaagtatgaggatgaaatcaacaagcggacaaatgcagagaatgaatttgtgaccatcaagaaggatgtggatggtgcttatatgaccaaggtggaccttcaggccaaacttgacaacttgcagcaggaaattgatttccttacagcactctaccaagcagagttgtctcagatgcagactcaaatcagtgaaactaatgtcatcctctctatggacaacaaccgcagtctcgacctggacagcatcattgctgaggtcaaggcccagtacgaggatatagcccagaagagcaaagctgaggccgagtccttgtaccagagcaagtatgaagagctgcagatcactgctggcagacatggggatagtgtgagaaattcaaagatagaaatttctgagctgaatcgtgtgatccagagacttagatctgaaatcgacaatgtcaagaagcagatctccaacttgcagcagtccatcagtgatgcagagcagcgtggcgagaatgccctcaaggatgccaagaacaagctgaatgacctggaggatgccctgcagcaggccaaggaagacctggcccgcctgctgcgtgactaccaggagctgatgaacaccaagctggccctggatctggagattgccacctacaggaccctcctggagggagaagaaagcaggatgtctggagaatgtgccccgaacgtgagtgtgtctgtgagcacaagccacaccaccatcagtggaggtggcagccgaggaggtggcggcggtggctacggctctggaggtagcagctatggctccggaggtggtagctatggttctggaggtggcggcggcggcggccgtggcagctatggctccggaggtggcagctatggctctggaggtggcggcggcggccatggcagctacggctccggaagcagcagtgggggctacagaggtggctctggaggcggcggcggcggcagctctggcggccggggctctggcggcgggagctctggaggctccataggaggccggggatccagctctgggggtgtcaagtcctctggtggcagttccagcgtgaagtttgtttctaccacttattccggagtaaccagataaagagatgccctctgtttcattagctctagttctcccccagcatcactaacaaatatgcttggcaagaccgaggtcgatttgtcccagccttaccggagaaaagagctatggttagttacactagctcatcctattcccccagctctttcttttctgctgtttcccaatgaagttttcagatcagtggcaatctcagtcccctggctatgaccctgctttgttctttccctgagaaacagttcagcagtgaccaccacccacatgacatttcaaagcacctccttaagccagccagagtaggaccagttagacccagggtgtggacagctccttagcatcttatctctgtgctgttttggttttgtacataaggtgtaagcaagttgtttttcttttgtggagaggtcttaaactccccatttccttgttttgctgcaataaactgcatttgaaattc

SEQ ID NO: 303967 - DNA, 1308 bp, Homo sapiens
ctccttcccttactctaccttgctcctacttttctctaagtcaacatgagtcgacagtttagttccaggtctgggtaccgaagtggagggggcttcagctctggctctgctgggatcatcaactaccagcgcaggaccaccagcagctccacacgccgcagtggaggaggtggtgggagattttcaagctgtggtggtggtggtggtagctttggtgctggtggtggatttggaagtcggagtcttgttaaccttggtggcagtaaaagcatctccataagtgtggctagaggaggtggacgtggtagtggctttggtggtggttatggtggtggtggctttggtggtggtggctttggtggtggtggctttggtggaggtggcattgggggtggtggctttggtggttttggcagtggtggtggtggttttggtggaggtggctttgggggtggtggatatgggggtggttatggtcctgtctgccctcctggtggcatacaagaagtcactatcaaccagagccttcttcagcccctcaatgtggagattgaccctgagatccaaaaggtgaagtctcgagaaagggagcaaatcaagtcactcaacaaccaatttgcctccttcattgacaaggtgaggttcctggagcagcagaaccaggtactgcaaacaaaatgggagctgctgcagcaggtagatacctccactagaacccataatttagagccctactttgagtcattcatcaacaatctccgaaggagagtggaccaactgaagagtgatcaatctcggttggattcggaactgaagaacatgcaggacatggtggaggattaccggaacaagtatgcacggctgaaatcacaacacacgacggacaacatgcacgcagacatgacattcgggaccatcaagacggatgtgcgatggtgcgttatatgaccaaggtgggcaccttcagagccacaactaggaccaacttagccagcagggacactcggagtaaccaataaacagacacctcatacccaaggacagcagtaggatctacaagaatggcagacctccacaatcaagtcgcacactaaacgaggtacaataccagcatacgaatagggaacgaacaaagcgccggaagagcaccgacaccagggaacacgacatgacaataggcatggaaggagtcaaaagaggacccaagaatacagacggcacaactcaggccccacgaacacaagagcacacagctgaagagacccggagagccaccaggaaccgcacagcaggcaaacgaatatgaca

SEQ ID NO: 303968 - DNA, 925 bp, Homo sapiens
tttgtactcttgctgagaaaaaatgacaggatgtctggagaatgtgccccgaacgtgagtgtgtctgtgagcacaagccacaccaccatcagtggaggtggcagccgaggaggtggcggcggtggctacggctctggaggtagcagctatggctccggaggtggtagctatggttctggaggtggcggcggcggcggccgtggcagctatggctccggaggtggcagctatggctctggaggtggcggcggcggccatggcagctacggctccggaagcagcagtgggggctacagaggtggctctggaggcggcggcggcggcagctctggcggccggggctctggcggcgggagctctggaggctccataggaggccggggatccagctctgggggtgtcaagtcctctggtggcagttccagcgtgaagtttgtttctaccacttattccggagtaaccagataaagagatgccctctgtttcattagctctagttctcccccagcatcactaacaaatatgcttggcaagaccgaggtcgatttgtcccagccttaccggagaaaagagctatggttagttacactagctcatcctattcccccagctctttcttttctgctgtttcccaatgaagttttcagatcagtggcaatctcagtcccctggctatgaccctgctttgttctttccctgagaaacagttcagcagtgaccaccacccacatgacatttcaaagcacctccttaagccagccagagtaggaccagttagacccagggtgtggacagctccttagcatcttatctctgtgctgttttggttttgtacataaggtgtaagcaagttgtttttcttttgtggagaggtcttaaactccccatttccttgttttgctgcaataaactgcatttgaaattc

SEQ ID NO: 303969 - DNA, 6371 bp, Homo sapiens
aggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgaca

SEQ ID NO: 303970 - DNA, 6771 bp, Homo sapiens
aggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgacaaaaaaaaaaaaaaaaaaaaaaaaaaaaaaaaaaaaaaaaaaaaaaaaaaaaaaaaaaaaaaaaaaaaaaaaaaaaaaaaaaaaacacgacaaaaaaacgtaggtcgggccgcggcaggcgatcaagacagaagataaacgtaaagagagggcagcgcagcagcaaaccactatgatagactgaggaggaggtcgaggacaaggtgaaacggacaagacgacggagagaagagcgagacggggggaaaacacaaaaaacagaagagcgcgagaggggaagaccggtgagagagaacaacgcacggcaggtgggaagaggcagaggagcggagcacagagagaggagaggagaggaagctaattaacagcgggcggcggggataaggacgacgagggggggc

SEQ ID NO: 303971 - DNA, 7231 bp, Homo sapiens
aggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctttttctccagtacttggtacagaatagagcagccaggcccaatgtggaagggtgggcttggtttcctgacaagccaggttagaccaataatggttgaagaggctgccctgggctcagaatgggcagctggtccttgcctgggagaactttgtggaaggaaaaggtaagattccttaagtccaaggagagaaccaatccagggtcaaatttcttttcattccctggatcacaacacaccagggaagagaggagtcaagaatgtctctccctgccagtgctcccctcctacctcgcaactcggctctcccttcccgacagttgtcctttgaaaggacggaaagcgcacttcagtttgttgttgtttttcctcatactgaaataaagcactgaagctcaaaatagaggtgagaatggagttctgctttccccagtgctatgtgcccccatctcacaagactgcctggatgcaagaggtgccaaggccctctctgccaactcaaacaggcactactgtttccttggctgccagcacaatcctggctccttgtgtttatactcctgggggaacctgtcccaagagatccatcctgctcttttcctgccaacccagctagtccccaaatcacctgctcttatcaagataatctggccccccatagcaggctagacaaaggcagctggaaaggacaggccagactggaagcaagccacacagatgcaagaagaaacctgccctcgctaggcagctgatctactggtaccaatctagtctcataacaaaatgaggaaatctagccctcttgccccagagagatttaaatacagagagtcttagtttggactgaaagagaaaaattgctctgatctttctaaagcttgaacattaaggcttctttgcaattttcttagagctctttgatcgttaattatatctttccatcgaagagaagcagatttcttctgagatttctgaacagttcctgggtgtttccg

SEQ ID NO: 303972 - DNA, 6317 bp, Homo sapiens
aggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaatgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgaca

SEQ ID NO: 303973 - DNA, 7176 bp, Homo sapiens
aggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagtctgtggaggccaaaccaactctttgccagcagccacaacatgcattgacagcggcacagtgagatataactgatgggctttgaacctggttggccggggaagctgtaggggtggatagagctttttctccagtacttggtacagaatagagcagccaggcccaatgtggaagggtgggcttggtttcctgacaagccaggttagaccaataatggttgaagaggctgccctgggctcagaatgggcagctggtccttgcctgggagaactttgtggaaggaaaaggtaagattccttaagtccaaggagagaaccaatccagggtcaaatttcttttcattccctggatcacaacacaccagggaagagaggagtcaagaatgtctctccctgccagtgctcccctcctacctcgcaactcggctctcccttcccgacagttgtcctttgaaaggacggaaagcgcacttcagtttgttgttgtttttcctcatactgaaataaagcactgaagctcaaaatagaggtgagaatggagttctgctttccccagtgctatgtgcccccatctcacaagactgcctggatgcaagaggtgccaaggccctctctgccaactcaaacaggcactactgtttccttggctgccagcacaatcctggctccttgtgtttatactcctgggggaacctgtcccaagagatccatcctgctcttttcctgccaacccagctagtccccaaatcacctgctcttatcaagataatctggccccccatagcaggctagacaaaggcagctggaaaggacaggccagactggaagcaagccacacagatgcaagaagaaacctgccctcgctaggcagctgatctactggtaccaatctagtctcataacaaaatgaggaaatctagccctcttgccccagagagatttaaatacagagagtcttagtttggactgaaagagaaaaattgctctgatctttctaaagcttgaacattaaggcttctttgcaattttcttagagctctttgatcgttaattatatctttccatcgaagagaagcagatttcttctgagatttctgaacagttcctgggtgtttccg

SEQ ID NO: 303974 - DNA, 6152 bp, Homo sapiens
aggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagccaggagctctcaacatatgtctaactggtgtggaacagccaccctcacatggccggtgctatctgtcagctggaaagtagtctacctgtgtttactatccccctttgtggggacccctgcggccaatgtgggggcgatatagggcagggcgacagggaagctggggaactccccaaaaatgttgttgaaaggcgcctag

SEQ ID NO: 303975 - DNA, 6869 bp, Homo sapiens
aggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctttttctccagtacttggtacagaatagagcagccaggcccaatgtggaagggtgggcttggtttcctgacaagccaggttagaccaataatggttgaagaggctgccctgggctcagaatgggcagctggtccttgcctgggagaactttgtggaaggaaaaggtaagattccttaagtccaaggagagaaccaatccagggtcaaatttcttttcattccctggatcacaacacaccagggaagagaggagtcaagaatgtctctccctgccagtgctcccctcctacctcgcaactcggctctcccttcccgacagttgtcctttgaaaggacggaaagcgcacttcagtttgttgttgtttttcctcatactgaaataaagcactgaagctcaaaatagaggtgagaatggagttctgctttccccagtgctatgtgcccccatctcacaagactgcctggatgcaagaggtgccaaggccctctctgccaactcaaacaggcactactgtttccttggctgccagcacaatcctggctccttgtgtttatactcctgggggaacctgtcccaagagatccatcctgctcttttcctgccaacccagctagtccccaaatcacctgctcttatcaagataatctggccccccatagcaggctagacaaaggcagctggaaaggacaggccagactggaagcaagccacacagatgcaagaagaaacctgccctcgctaggcagctgatctactggtaccaatctagtctcataacaaaatgaggaaatctagccctcttgccccagagagatttaaatacagagagtcttagtttggactgaaagagaaaaattgctctgatctttctaaagcttgaacattaaggcttctttgcaattttcttagagctctttgatcgttaattatatctttccatcgaagagaagcagatttcttctgagatttctgaacagttcctgggtgtttccg

SEQ ID NO: 303976 - DNA, 5788 bp, Homo sapiens
aggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccagagagatttaaatacagagagtcttagtttggactgaaagagaaaaattgctctgatctttctaaagcttgaacattaaggcttctttgcaattttcttagagctctttgatcgttaattatatctttccatcgaagagaagcagatttcttctgagatttctgaacagttcctgggtgtttccg

SEQ ID NO: 303977 - DNA, 6087 bp, Homo sapiens
agttagtgtgtgtcagaattgccagggcagctggttaaaaatgcagattcctagtccccactcgaaattgattatagtagattgagcttttttgctgggatccaggtttctgcaccaggggcttgtgatcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgaca

SEQ ID NO: 303978 - DNA, 6317 bp, Homo sapiens
aggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgaca

SEQ ID NO: 303979 - DNA, 2295 bp, Homo sapiens
tcggctagtagaggccggggtgaatcggccgaggctttcagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgaca

SEQ ID NO: 303980 - DNA, 1300 bp, Homo sapiens
tgtcactgcaaattgtttattaaaacacaaagcaatggacagtgaaaaacatcctgattttgtactttttggtgggagtggggtgggacatggaaggggtagggtcagatggagacagcccagaaggaaagccagctctatccacccctacagcttccccggccaaccaggttcaaagcccatcagttatatctcactgtgccgctgtcaatgcatgttgtggctgctggcaaagagttggtttggcctccacagagagaggatgggaaactagggtagaagctacaagggctaagaacttgatgctttttctccagtacttggtacagaatagagcagccaggcccaatgtggaagggtgggcttggtttcctgacaagccaggttagaccaataatggttgaagaggctgccctgggctcagaatgggcagctggtccttgcctgggagaactttgtggaaggaaaaggtaagattccttaagtccaaggagagaaccaatccagggtcaaatttcttttcattccctggatcacaacacaccagggaagagaggagtcaagaatgtctctccctgccagtgctcccctcctacctcgcaactcggctctcccttcccgacagttgtcctttgaaaggacggaaagcgcacttcagtttgttgttgtttttcctcatactgaaataaagcactgaagctcaaaatagaggtgagaatggagttctgctttccccagtgctatgtgcccccatctcacaagactgcctggatgcaagaggtgccaaggccctctctgccaactcaaacaggcactactgtttccttggctgccagcacaatcctggctccttgtgtttatactcctgggggaacctgtcccaagagatccatcctgctcttttcctgccaacccagctagtccccaaatcacctgctcttatcaagataatctggccccccatagcaggctagacaaaggcagctggaaaggacaggccagactggaagcaagccacacagatgcaagaagaaacctgccctcgctaggcagctgatctactggtaccaatctagtctcataacaaaatgaggaaatctagccctcttgccccagagagatttaaatacagagagtcttagtttggactgaaagagaaaaattgctctgatctttctaaagcttgaacattaaggcttctttgcaattttcttagagctctttgatcgttaattatatctttccatcgaagagaagcagatttcttctgagatttctgaacagttcctgggtgtttccg

SEQ ID NO: 303981 - DNA, 4722 bp, Homo sapiens
aggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacaaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgaca

SEQ ID NO: 303982 - DNA, 2395 bp, Homo sapiens
aggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgaca

SEQ ID NO: 303983 - DNA, 1616 bp, Homo sapiens
tcggctagtagaggccggggtgaatcggccgaggctttccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgaca

SEQ ID NO: 303984 - DNA, 1566 bp, Homo sapiens
ctggctgactagaggacccttagaatcgtggtgctgctccaacatgtggtgtgtactggatttctggcttagatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgaca

SEQ ID NO: 303985 - DNA, 1102 bp, Homo sapiens
tgatctcctagaggatcccccagctgcatggtgtttgcagctgcattgtgtgtttgcagctgcattgtgtgtttgcagctgcattgtgtgtttgcagctggcattgtgtgtttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgaca

SEQ ID NO: 303986 - DNA, 1360 bp, Homo sapiens
  misc_feature (52)..(52): n is a, c, g, or t
atgaaattcagaaggactgtgctcttaggctttccacgactttgttccccanggcagcaacagcttccaacgttggcagaatcttgagtatcaccaccaggtcagccacattgtgtcctgtagtcattgtcccctttttataggatcccacctgtcgaacttcttcaatttgcacttcaaatgtccctggagccacaatcagattatcaatcacattgtttatttttgtcaccagagaaaggatagatgcctgttcagcagaattgggagccaggtcctgattcctcttcagcaaggcctcactgaaggaagtttcatcaggtgctggcttgacccggggaaaggccatttcacacaaatagaagtcaaatgggatatgtggtacaaagggcctgaaccctcctcctgggcctcctctggaaccaagcaacccctaggggttgctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgaca

SEQ ID NO: 303987 - DNA, 932 bp, Homo sapiens
tgtcactgcaaattgtttattaaaacacaaagcaatggacagtgaaaaacatcctgattttgtactttttggtgggagtggggtgggacatggaaggggtagggtcagatggagacagcccagaaggaaagccagctctatccacccctacagcttccccggccaaccaggttcaaagcccatcagttatatctcactgtgccgctgtcaatgcatgttgtggctgctggcaaagagttggtttggcctccacagagagaggatgggaaactagggtagaagctacaagggctaagaacttgatgcctcatactgaaataaagcactgaagctcaaaatagaggtgagaatggagttctgctttccccagtgctatgtgcccccatctcacaagactgcctggatgcaagaggtgccaaggccctctctgccaactcaaacaggcactactgtttccttggctgccagcacaatcctggctccttgtgtttatactcctgggggaacctgtcccaagagatccatcctgctcttttcctgccaacccagctagtccccaaatcacctgctcttatcaagataatctggccccccatagcaggctagacaaaggcagctggaaaggacaggccagactggaagcaagccacacagatgcaagaagaaacctgccctcgctaggcagctgatctactggtaccaatctagtctcataacaaaatgaggaaatctagccctcttgccccagagagatttaaatacagagagtcttagtttggactgaaagagaaaaattgctctgatctttctaaagcttgaacattaaggcttctttgcaattttcttagagctctttgatcgttaattatatctttccatcgaagagaagcagatttcttctgagatttctgaacagttcctgggtgtttccg

SEQ ID NO: 303988 - DNA, 1169 bp, Homo sapiens
tgtcactgcaaattgtttattaaaacacaaagcaatggacagtgaaaaacatcctgattttgtactttttggtgggagtggggtgggacatggaaggggtagggtcagatggagacagcccagaaggaaagccagctctatccacccctacagcttccccggccaaccaggttcaaagcccatcagttatatctcactgtgccgctgtcaatgcatgttgtggaagggtgggcttggtttcctgacaagccaggttagaccaataatggttgaagaggctgccctgggctcagaatgggcagctggtccttgcctgggagaactttgtggaaggaaaaggtaagattccttaagtccaaggagagaaccaatccagggtcaaatttcttttcattccctggatcacaacacaccagggaagagaggagtcaagaatgtctctccctgccagtgctcccctcctacctcgcaactcggctctcccttcccgacagttgtcctttgaaaggacggaaagcgcacttcagtttgttgttgtttttcctcatactgaaataaagcactgaagctcaaaatagaggtgagaatggagttctgctttccccagtgctatgtgcccccatctcacaagactgcctggatgcaagaggtgccaaggccctctctgccaactcaaacaggcactactgtttccttggctgccagcacaatcctggctccttgtgtttatactcctgggggaacctgtcccaagagatccatcctgctcttttcctgccaacccagctagtccccaaatcacctgctcttatcaagataatctggccccccatagcaggctagacaaaggcagctggaaaggacaggccagactggaagcaagccacacagatgcaagaagaaacctgccctcgctaggcagctgatctactggtaccaatctagtctcataacaaaatgaggaaatctagccctcttgccccagagagatttaaatacagagagtcttagtttggactgaaagagaaaaattgctctgatctttctaaagcttgaacattaaggcttctttgcaattttcttagagctctttgatcgttaattatatctttccatcgaagagaagcagatttcttctgagatttctgaacagttcctgggtgtttccg

SEQ ID NO: 303989 - DNA, 3213 bp, Homo sapiens
  misc_feature (506)..(506): n is a, c, g, or t
  misc_feature (1249)..(1249): n is a, c, g, or t
  misc_feature (1346)..(1346): n is a, c, g, or t
  misc_feature (1376)..(1376): n is a, c, g, or t
agctctcactcctttcgtgagaaatgtattctcttccagatatatcccttcctcagcttttctgctctggcctatctttgaaccaccatgtaagctggtgagccagttcttcatggaaactgcatggtacccatcagtcttggctaaaaatgtctgttgacaaagatgaaagtcctgccatcccctcaagacttagccttatccgcaggtagaaggcctagagaggctatgtcccaaatcctacctcaatgctgaattagactgggctcttgcttgtgctagtctgtattgaagagattagtcaagttaagaaccaaagggttcttaaactgctaggagaagaatagtggtcaaaagaatggcttctttctatcttgaactgaagccctggacttcacgggcctctgatgaggattccgcttgcagccctaagagggtctacctatggagatgacccttagctgtgtgatgcatgcacctgaccttctcctctcccctgtcatccntccccattcctgccctgttccctgttggtatgtgtctgagtttatttcactgttaaatcgtgcgtttgcctgtctttcgcagatatctccatgtctcctcaacaaactggagctaagtagtggggagcagaccaaagccctgaaccagttagagagggtactactctttaagaacctcaaggtctctctccctctctttcccttcccctttttatttctttcaatgtttattttttatatataacacctgggtcccatttccattgtgtagagcacaacttactcctccctagtaacacagcacggctttggaagagttgcacgtgattgtagctttgcagtgttggaattctcctggggcatctggttgcctggatacaggagaaggaagacttgaacatcacatagttagcctagaaagcctggggtctgctgttaccttgtggggaggcttaagatctaccatttctagggaaaccgtgagggaccttcaagcaagacccttccccttctaccttatccttgtctcagagctggcatagagagcttaagcacagtcctcagctctatctggattacctggactgggtttggagggaaagggtagtccatctagttgggatcttttttttttttttttttcttggttaccattaaagaggtcattccaaggattagaactctagattgatggaaagaagccaggtgccaggatagcccaggacactgggaatactttgggntctgtgaagatgccctctgtcctctaaaagtcaaggtataggggagcttaggggagggatccaagctaaagattaccctaatctgcatatacctgcnttaggaagaaaggggagagaaggaggtgtnggctgtctgggctgtccatcacaagagtgtgcatgctgaaggtgtggttgtggacatacaggtcactgaaagtaaaaaactctgtgtatgtacacctagctagatagtccattggcccgtgttctctttgaatgcattgtgtcatttcatttgtgtgcttgcacagtctcaagctgcagctctcattagtggctatccagcatgttgccatgattattaacctgggacctgctccttttttgtaaagcttacactgtcctttggagtacagagtcatacagataaggtggcgtagaattccatgaatacctactgcccaccccacaccttcagaccttaggagagggagaatagctataccttttaagggctgaggcattcgtgagaactggcagcctcttggcccctactccagccagcaggctgagaacactaattgaaatgatcaggttggagcaagctttgcagaagatagagaaggaaacgtgaaaaactgatcctcgtatgggaaggaatctcaatgactgactggcttctcagtggaagtaggactgcctggagtccctgaaatgggggagcctcctggagagaaaggctacctcataaaagtagatccagttcttagtacttttgggagctcaatgataactgccagtagagccaggaggtctctcattgatctcttggcctcttgcccttttgcatgtttggcggactcttctcccataacattttttactatgaacttgatccagttgagctccagtggttcctggggagagaatccttttgcttcctccttagctatagcggtcagtacgcctgaagctcagttctaagcatatgactgcaggcattttggagatggatcatctagaagtataaatccagtatgaggctgttgctatgttactaagagctgggggaaggaagggctcagctgttcagcctcatctttattggaaggagctatgggtaggaatggaagaattgtgtggtttctaagcaaggaatcaaagattacccaggttctgagagcttgggggagcttgaggaagggagtcaatccctcactatcaaaaggaattgaacaggccatggacaataggatatattcagcctttaggaagaggcagagagaaaaagtgcttctgctctctttagagtcattctaatggtttctggaagagtgttgccattgcccaatccaggaatggtccaatccaagaatggtctatcagtctaggaatagtttagaatgactttgtagagggactgagttcaaacccaactgagaaaacatcagggcttaaaaaacaaattgggccgggcacagtggctcacacctgtaatcccagtactttgggaggccaaggcgggcggatcacgaggtcaggagatcgagaccatcctggctagcacggtgaaaccccgtctctactaaaaatacaaaaagaattagccaggcttggtggcgggcgcctgtagtcccagctactcaggagactgaggcaggagaatggcgtgaacccaggaggcggagcttgcagtgagccaagatcacgccactgcactccagcctgggtggcacagtgagactctgtctcaaaaaaaaaaaaaaaaaaaatggggcctaaacaaagtaactttgaacttagaatggaggaaatacataaaaacacagatcctagggaatagttaacaaacaggtgatagagattgtcccttgccactaaaagtaagctataggaagaacagaaatactgtacaggggaataaaagagatcttatttttttttttatacttggcgttttttgaataaaaaccttttgtctt

SEQ ID NO: 303990 - DNA, 433 bp, Homo sapiens
cagcagagagcacagcagcagcgtgacatgaccttctatcctgaactccacaaagaaactgggaggccactccttccttaactccaaggaatgagcttttgaccaatctgatacagaaattccagagagtaagagatatgttagctgggtgcagtggctcacacctgtaatcccagcactttgggaggctggggcaggcagatcacctaaggtcaggagttagagactagcctggccaacatagtgaaaccctgtctctactaaaaatacaaaaattatccaggcgtggtggtccacacctgtaatcccatttactcaggaggctgaggcaggagaatcacttgaacccaggaggcagaggttgcagtgagctgagatcgtgccactgcactccagcctgggtggcaaagctagactccatctcaaaaaaaaa

SEQ ID NO: 303991 - DNA, 281 bp, Homo sapiens
agcaagaggggagtgcaacagagcaaggagtcaaggaatcagtggccttaccatctgacaacataaaactgcatctggaaagaccaatagtgagagggccagagggacaggtagtctcattgatataacaaattgggagcagcagagagcacagcagcagcgtgacatgaccttctatcctgaactccacaaagaaactgggaggccactccttccttaactccaaggaatgagcttttgaccaatctgatacagaaattccagagagtaagagatatgtt

SEQ ID NO: 303992 - DNA, 387 bp, Homo sapiens
catctttctacagtatttcctacagctaaagcctcaggccattgcctaattaacaatgaagatttcatggacatcctacacttcaggattacttgactatctcaaacacataaatcaaaatgggccaagtagcaaatcttgatgaatttccactcttaccatccattcttactaccaacagtataactgaacatgtgattagaatgatctatattaatgtttagttatttttggttgagtgctaaatatttcagaaggctacttaacatgtaagataccaacttcaacactgtaataacatatactgtgaaaacattcctaaaaagtaaccaaagggtttgctaactctgcttcaacatccaacaacacaaaactatatgattttta

SEQ ID NO: 303993 - DNA, 2040 bp, Homo sapiens
agcctggctctcagcacacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcaccacggggaccgctcccgcggaaagaggttcagccagagcttccgagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactcagaagaaataaaaaatgatgtttcaaaaaaaa

SEQ ID NO: 303994 - DNA, 1420 bp, Homo sapiens
agcctggctctcagcacacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcaccacggggaccgctcccgcggaaagaggttcagccagagcttccgagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgagcaataatggggaatgagagcaacacaatgatctgaagaaaggacccccaacctctagggcgcaagactataatagttaaatttatatagatgaggctttcatttatgatatttctattttctcacacaactctcattccaaaaatattaaacaatcactcacgg

SEQ ID NO: 303995 - DNA, 1278 bp, Homo sapiens
  misc_feature (5)..(5): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 303996 - DNA, 444 bp, Homo sapiens
tataagtgtatcagtagagataagaaagccttctcaagcatttcctttctgtcttctacctttttgacttttattcagtctctcctagctgtcatttatccacagctgtcctcatacccagtgtctaccatagagctggccaaagccagcctttttgctccctttccacccaaccccccactcattgtgtattctttgtcttccaggacccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 303997 - DNA, 376 bp, Homo sapiens
tggaccagttggtgcccaggaagtctcggtaggaagtaaggcccaggcgcaggagcagctgtggcccccgagagccaataggcgccagggtggctgagtgcaggcggaacttgggggcgtcgaagagccagggttgggcctttagccgggtctcccaggcgccgtcgcgtgcgtaggcgacggcgcagaccccagcgcccgctctgcctggtcctgctcttccagggcccttccccggcggccgcgtggtcaggctgcacccagtcattttggcctccattgtggacagctacgagagacgcctgcagacccaggtcttcaagctgggcttggcacaagtccatccaccacgctcgcgtgctgatcctccagcgcc

SEQ ID NO: 303998 - DNA, 1278 bp, Homo sapiens
agattccatttgaacgtttgaaagtatagcttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 303999 - DNA, 1450 bp, Homo sapiens
aaagacagaatctcactctgtcgcccaggctggagtgcagtggcaaatctcagctcgctaaaacttccgcctctcaggctcaagcaattctcatgcctcggcatccctagtaactgggattacaagtgggcgccaccatgcccagataattttttctatttttagtagagacagagtttcactgtgatagtcaggttggtcccgaactcttgtcctcatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 304000 - DNA, 1261 bp, Homo sapiens
  misc_feature (5)..(5): n is a, c, g, or t
aactntaggctaggtacgaggctggttggaattcggccgaggcagatggccacaccggcggtaccagtaagtgctcctccggccacgccaaccccagtccccagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 304001 - DNA, 1252 bp, Homo sapiens
acacaaaacaaactaggcagtagagcggtgttaatggagaggcacggggacagtaagtctcctccggcacgccaacccagtcccggcggcggcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 304002 - DNA, 1609 bp, Homo sapiens
  misc_feature (5)..(5): n is a, c, g, or t
  misc_feature (1374)..(1374): n is a, c, g, or t
  misc_feature (1376)..(1376): n is a, c, g, or t
  misc_feature (1421)..(1421): n is a, c, g, or t
  misc_feature (1425)..(1425): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaatttcatcttatgtgagtttattgccgggtggaagggaggaaaatgttttagatcacacagaaactaggaagtgaatattgtaggtagagaagttgntnatgtgtttggcatgttactgttttaccaaactgttctttggtttncaanatggaaaggtgtccattggcaaaacaagcttttcttgaggattcatgtgatttctacaggaaatgaaattagaatccatggggaaaaactagctaagaaattggatgcttaatctgaactaaagagtataggtgtatcatatcttaaataacttatattagatgggccttgccctggtcgggac

SEQ ID NO: 304003 - DNA, 1365 bp, Homo sapiens
  misc_feature (5)..(5): n is a, c, g, or t
  misc_feature (1291)..(1291): n is a, c, g, or t
  misc_feature (1293)..(1293): n is a, c, g, or t
  misc_feature (1295)..(1295): n is a, c, g, or t
  misc_feature (1308)..(1308): n is a, c, g, or t
  misc_feature (1311)..(1312): n is a, c, g, or t
  misc_feature (1317)..(1317): n is a, c, g, or t
  misc_feature (1328)..(1328): n is a, c, g, or t
  misc_feature (1330)..(1330): n is a, c, g, or t
  misc_feature (1334)..(1334): n is a, c, g, or t
  misc_feature (1342)..(1342): n is a, c, g, or t
  misc_feature (1355)..(1355): n is a, c, g, or t
  misc_feature (1361)..(1361): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaaaaaaaaaaaaaantntntgtggggcggttnggnnctganaaaagtttttnanaacnaattttgntggggggcggggncccagntagg

SEQ ID NO: 304004 - DNA, 1358 bp, Homo sapiens
  misc_feature (5)..(5): n is a, c, g, or t
  misc_feature (1357)..(1357): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagttggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacgatgttna

SEQ ID NO: 304005 - DNA, 1192 bp, Homo sapiens
  misc_feature (5)..(5): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacattgtgtgtgactctaataaacggagcctaccttttgtaaatttaaaaaaaaaaa

SEQ ID NO: 304006 - DNA, 1311 bp, Homo sapiens
  misc_feature (5)..(5): n is a, c, g, or t
  misc_feature (1235)..(1235): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgatgagtgccccttcctgagccccttcttgcctggtttcttcccccacctcagcacatacactcaaatgtgaaaagagttgggtgaggtgacctggggagtaggatagagacagggcttcacctatagccccactgaagtccaggttgggaggaaggaagaggtgtgttatgcgtggttggagacttccttccntctcccatgattccattgtctcatttactgctgatactactgtgacttactgtctaaattcgtgatggaaagaaac

SEQ ID NO: 304007 - DNA, 1146 bp, Homo sapiens
  misc_feature (5)..(5): n is a, c, g, or t
  misc_feature (912)..(912): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaattncgacgcatgacatgtgccggaacagtcggcaagtgaccactacaggtaggccccgcccgaatcaacggagtaaaccaatgacggaacaaaagccccgaaagattggaaccagtccaacaggaaagaagagctaagcaataggcaacaccgggcaccgtccaagcacacttgccacacgcaaaaatcaacagacatggcgaacacgaacgccgcgacgacacacagagcaacgcg

SEQ ID NO: 304008 - DNA, 1072 bp, Homo sapiens
tgatacaattcagctcggtacccacaccacctgagtcagaagatgaagtgagtgggaatccaagctgtccctctgcagtttttagctgttcatttgctcggctcccctcacggtccctcccacactcataactagagctcctgtagccaaggagcttcttcccgtttgtacgtacttcctgggcctcttctgtttattgggggcggcctcttgtcctttttaaccaatttttctttggacttctggcttcttagcttgctttcctgccttccctcttagggttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 304009 - DNA, 1150 bp, Homo sapiens
  misc_feature (5)..(5): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagttaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 304010 - DNA, 1244 bp, Homo sapiens
  misc_feature (5)..(5): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 304011 - DNA, 1183 bp, Homo sapiens
  misc_feature (5)..(5): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 304012 - DNA, 1203 bp, Homo sapiens
  misc_feature (5)..(5): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacataagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 304013 - DNA, 512 bp, Homo sapiens
actagttctctctctcctcgtgccgaattcggcacgagaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 304014 - DNA, 779 bp, Homo sapiens
  misc_feature (5)..(5): n is a, c, g, or t
aactntaggctaggtacgaggctggttggaattcggccgaggcagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacattcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaa

SEQ ID NO: 304015 - DNA, 740 bp, Homo sapiens
tacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatttaaaaaaaaaaaaaaaaaaaaagtaaagcttattgtaaaa

SEQ ID NO: 304016 - DNA, 1566 bp, Homo sapiens
cagtctcacttcagttccttttgcatgaagagctcagaatcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactaga

SEQ ID NO: 304017 - DNA, 1129 bp, Homo sapiens
caggcatttctagcccctgagagcagtttcccaaagagcctgcagagggagcttcccaaggaccttgggtccttccagggttgacaccactcaccaccctctgtgagcctgggagttatggggtgaaaggtcccaacaagctcttctatctgcttgatgcaggaggcagcatccttggccagagtaatgggctctctgcctggacccctcccagccatcccacttctcttccttttgcagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactaga

SEQ ID NO: 304018 - DNA, 1137 bp, Homo sapiens
aaccccttcccatgcgctctaaccatgaggttcttgctctcagggaacaatttctaggtcagcacagaggtagggttccaggtctgcgtgctctctctgatcatgggagccccaggcacaaagccctccacccatgtgtcttcttcctgctgattccttgagttctcttgtcctaggctttcactctaccttatggtgagcacttctttctctcctacaagcttagagttctcagatagtaggggcaacttctgcttcctcattgcatcccccaaagcagctagcatggcgccttgcatataaaaggtactcaatatttacattgatttcacctggccaagatgaactctattgaggttttgttgttgcagatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactaga

SEQ ID NO: 304019 - DNA, 1379 bp, Homo sapiens
gagcgatctagaggatcccgtatgttatcccaacacattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactaga

SEQ ID NO: 304020 - DNA, 1566 bp, Homo sapiens
gcctcagtcagcccccgggggaggccatgaacgccacggggaccccggtggcccccgagtcctgccaacagctggcggccggcgggcacagccggctcattgttctgcactacaaccactcgggccggctggccgggcgcggggggccggaggatggcggcctgggggccctgcgggggctgtcggtggccgccagctgcctggtggtgctggagaacttgctggtgctggcggccatcaccagccacatgcggtcgcgacgctgggtctactattgcctggtgaacatcacgctgagtgacctgctcacgggcgcggcctacctggccaacgtgctgctgtcgggggcccgcaccttccgtctggcgcccgcccagtggttcctacgggagggcctgctcttcaccgccctggccgcctccaccttcagcctgctcttcactgcaggggagcgctttgccaccatggtgcggccggtggccgagagcggggccaccaagaccagccgcgtctacggcttcatcggcctctgctggctgctggccgcgctgctggggatgctgcctttgctgggctggaactgcctgtgcgcctttgaccgctgctccagccttctgcccctctactccaagcgctacatcctcttctgcctggtgatcttcgccggcgtcctggccaccatcatgggcctctatggggccatcttccgcctggtgcaggccagcgggcagaaggccccacgcccagcggcccgccgcaaggcccgccgcctgctgaagacggtgctgatgatcctgctggccttcctggtgtgctggggcccactcttcgggctgctgctggccgacgtctttggctccaacctctgggcccaggagtacctgcggggcatggactggatcctggccctggccgtcctcaactcggcggtcaaccccatcatctactccttccgcagcagggaggtgtgcagagccgtgctcagcttcctctgctgcgggtgtctccggctgggcatgcgagggcccggggactgcctggcccgggccgtcgaggctcactccggagcttccaccaccgacagctctctgaggccaagggacagctttcgcggctcccgctcgctcagctttcggatgcgggagcccctgtccagcatctccagcgtgcggagcatctgaagttgcagtcttgcgtgtggatggtgcagccaccgggtgcgtgccaggcaggccctcctggggtacaggaagctgtgtgcacgcagcctcgcctgtatggggagcagggaacgggacaggcccccatggtcttcccggtggcctctcggggcttctgacgccaaatgggcttcccatggtcaccctggacaaggaggcaaccaccccacctccccgtaggagcagagagcaccctggtgtgggggcgagtgggttccccacaaccccgcttctgtgtgattctggggaagtcccggcccctctctgggcctcagtagggctcccaggctgcaaggggtggactgtgggatgcatgccctggcaacattgaagttcgatcatggta

SEQ ID NO: 304021 - DNA, 1866 bp, Homo sapiens
  misc_feature (1144)..(1144): n is a, c, g, or t
cagggatacaacagagtggaggaagctggaatacagaatgcacttagaaggaggctggattggaggtgaaaactgagttgccagttcagagtttgagctggtagctgggcagaaagcaggctagttaattgaaggactttgtacagattctttacaggctaatatgatttcccaaatgattggatgcatcatatataaaggaaagcaactgagaagagaaagactgtgtagaacaggtttagggggaagaattatggactaagttttaggtacatgaagtttggaattttatctcttgagtgtattaaaaataaccaagattcaagatgagggtagccttgaaacaaaagagaggagctcaaatcattggaagagaggagtgtaactttgacataggtatgactgcagcagtgagggcagcaaagaaaagtactaggtaatttctaaccctatccatatgtgatgagtcactaatcagagttgtgtgcctaagcttctaatgcaggtcttggtgagaaatgatgactctagattgatgaagaggaagaacaaaatccagtccttattggtggaataacagaagcaaatataagaatgtctcctttgctactggctatacttcagtggttacagcttaggccaatgagatatttggcagaggcttgcaagttgggaagagatttctttctgaaataaaacaacaaagctttctgagagacattttcctctattctgaactgtggatattagccctggggagcagtagccaccttgcaaccatgagggaaaaagtctagggaagaaagacaacacaggaaaggtggcagagctgggacactgctggagggttgttacccaaggcagcacttaatatatccaccagttgaacaatgagaacacttggacacagggtggggaacgtcacacactcgggcctgtcgtggggtggggggacgggggagggatagcattaggagacatacctaatgtaaacgacaagttaatgggtgcagcacaccaacatggcacatgtatacatatgtaacaaacctgcatgttgtgcacatgtaccctagaacttaaagtataataaaaagaaagaaaaagaaagaaagaaagaaagaaaagaaaagaaaaggaaagnaaagaaaagaaaagaaaagaaaagaaaaaagaaaaagaaatatctccaccaacagggatagggctatgtgctgtggatttttaagcttatatatatttttttcttttggagacaaggtctctctctagcacccaggtaggagtgtagtggtatgatcatagttttttgtaacctccaactcctgggctcataacattataaaacttaaatggaatgctcatataagaaaataattcaaaatcataaatacaaaatgaatgagggatcaatcttttgacagaatagtccagagttacttacactctggattaaactatttgttttggtaaactatttgtttactagatacataatatatgaattattagaaaatctattaagaaaaatcagataagggaaataggtactctcacaatattcaaattggtcttgaaaatttataaaggtaattgaagcacattttcctttatatcaaagaaataaaaatgagacttccactttccatcagagatgcagggagcaggaatgtctcacccacacccttacaatagaaaaagatggataaaatgcaaatcataacttttcttgaacccatcaggagttgagcttaccaggcaaacagctaactggaaatctagagagagatgggctcctgtaagaagacataggatttgaacacttgtttacttgaagcagaagtcaaccagtgctgtataagtaaa

SEQ ID NO: 304022 - DNA, 637 bp, Homo sapiens
tctgcctccaggcacagtaagagagagaacctccaggttgtccagaagcccggccaaatgcgctactctcctcacctgcctggtccgacggctgaggtctggcctgcttgttgtattaccatctcttttcccaacaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgctttactacctgatgatgaattcttcaaaggcaagtttccctaaaaaagcaacacgtctaaaatgaaggtagaaattcaactagttgaactcaaaatttgtgttttgcccaattccaatagcttttgccctcagagcaagccctcactccaaagaggttcagatgctcacgatgtttctcctgtgttgagtctagcctgcataatggaaattggattgtcttcttcccccgagggttcccagtcttgcatagataaagagagtctgaggcag

SEQ ID NO: 304023 - DNA, 1789 bp, Homo sapiens
accggccactgtacgggcctttctggacttggactccttgggagtcgtttctcggccatttgacccgtgggacttgtgggttttgtgctgctttttctttctttcttccccttttccaacttcagcaatacacccagatgttagtcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactgtggcgtggtacatcagaaggctgactgggacagcatccatgagaaaatatgtcagctcttgattccactgcgcacttccatgcccttctacaattcagaggaagaacggcagcatggcctgcagcagctgcagcagcggcagaagtatttgattgaattctgctacaccatagcccagaaatacctctttgaagggaaacacgaagatgctgtaccagcagctttgcagtcccttcgcttccgtgtgaagctgtatggcctgagctccgtagagcttgtgcctgcttacctgctgttggccgaggccagccttggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgctttactacctgatgatgaattcttcaaaggcacaggaatatggcatgagggccctcagtctagccaaagaacaacagcttgatgtccatgagcaaagcaccattcaagagttattaagtctcatttcaactgaagaccatcccattacttagtgacccatgagctctgcatcaagggttattccaggggctactgaagatctaatatattccagccttgcacaactgctttgaggtactgtagactgctgaagtttccaccctcttcccctgggattgcacacatagctgttatttttttcttacacagcatattaagggaatataaagctttaggcatagaaatcactaaaaactgtgtttgtcatgacctttgtacttgatttatcatgactttgtatgactgagtaatatgtagtcagatcactaatatggtatttgtaattaaactacaaatagtttgtcatttcccagaagtcttccaacgatgcatgtttcatacacttttgctaaaggaggggtaaaggagggggtagggaataaagctatattggaacaaaaaaaaaa

SEQ ID NO: 304024 - DNA, 1773 bp, Homo sapiens
tcgtcctttcgcgcccatgttgcagccgttggcggacttgctgtcgctgggtcgcatgactagggcgtatcctggctgagcctctgtgtcccatatctgaggcacgtacgcccattgagtgttcacgctcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactgtggcgtggtacatcagaaggctgactgggacagcatccatgagaaaatatgtcagctcttgattccactgcgcacttccatgcccttctacaattcagaggaagaacggcagcatggcctgcagcagctgcagcagcggcagaagtatttgattgaattctgctacaccatagcccagaaatacctctttgaagggaaacacgaagatgctgtaccagcagctttgcagtcccttcgcttccgtgtgaagctgtatggcctgagctccgtagagcttgtgcctgcttacctgctgttggccgaggccagccttggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgctttactacctgatgatgaattcttcaaaggcacaggaatatggcatgagggccctcagtctagccaaagaacaacagcttgatgtccatgagcaaagcaccattcaagagttattaagtctcatttcaactgaagaccatcccattacttagtgacccatgagctctgcatcaagggttattccaggggctactgaagatctaatatattccagccttgcacaactgctttgaggtactgtagactgctgaagtttccaccctcttcccctgggattgcacacatagctgttatttttttcttacacagcatattaagggaatataaagctttaggcatagaaatcactaaaaactgtgtttgtcatgacctttgtacttgatttatcatgactttgtatgactgagtaatatgtagtcagatcactaatatggtatttgtaattaaactacaaatagtttgtcatttcccagaagtcttccaacgatgcatgtttcatacacttttgctaaaggaggggtaaaggagggggtagggaataaagctatattggaacaaaaaaaaaa

SEQ ID NO: 304025 - DNA, 1617 bp, Homo sapiens
accggccactgtacgggcctttctggacttggactccttgggagtcgtttctcggccatttgacccgtgggacttgtgggttttgtgctgctttttctttctttcttccccttttccaacttcagcaatacacccagatgttagtcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactgtggcgtggtacatcagaaggctgactgggacagcatccatgagaaaatatgtcagctcttgattccactgcgcacttccatgcccttctacaattcagaggaagaacggcagcatggcctgcagcagctgcagcagcggcaggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgctttactacctgatgatgaattcttcaaaggcacaggaatatggcatgagggccctcagtctagccaaagaacaacagcttgatgtccatgagcaaagcaccattcaagagttattaagtctcatttcaactgaagaccatcccattacttagtgacccatgagctctgcatcaagggttattccaggggctactgaagatctaatatattccagccttgcacaactgctttgaggtactgtagactgctgaagtttccaccctcttcccctgggattgcacacatagctgttatttttttcttacacagcatattaagggaatataaagctttaggcatagaaatcactaaaaactgtgtttgtcatgacctttgtacttgatttatcatgactttgtatgactgagtaatatgtagtcagatcactaatatggtatttgtaattaaactacaaatagtttgtcatttcccagaagtcttccaacgatgcatgtttcatacacttttgctaaaggaggggtaaaggagggggtagggaataaagctatattggaacaaaaaaaaaa

SEQ ID NO: 304026 - DNA, 1459 bp, Homo sapiens
tcgtcctttcgcgcccatgttgcagccgttggcggacttgctgtcgctgggtcgcatgactagggcgtatcctggctgagcctctgtgtcccatatctgaggcacgtacgcccattgagtgttcacgctcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgctttactacctgatgatgaattcttcaaaggcacaggaatatggcatgagggccctcagtctagccaaagaacaacagcttgatgtccatgagcaaagcaccattcaagagttattaagtctcatttcaactgaagaccatcccattacttagtgacccatgagctctgcatcaagggttattccaggggctactgaagatctaatatattccagccttgcacaactgctttgaggtactgtagactgctgaagtttccaccctcttcccctgggattgcacacatagctgttatttttttcttacacagcatattaagggaatataaagctttaggcatagaaatcactaaaaactgtgtttgtcatgacctttgtacttgatttatcatgactttgtatgactgagtaatatgtagtcagatcactaatatggtatttgtaattaaactacaaatagtttgtcatttcccagaagtcttccaacgatgcatgtttcatacacttttgctaaaggaggggtaaaggagggggtagggaataaagctatattggaacaaaaaaaaaa

SEQ ID NO: 304027 - DNA, 941 bp, Homo sapiens
accggccactgtacgggcctttctggacttggactccttgggagtcgtttctcggccatttgacccgtgggacttgtgggttttgtgctgctttttctttctttcttccccttttccaacttcagcaatacacccagatgttagtcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactgtggcgtggtacatcagaaggctgactgggacagcatccatgagaaaatatgtcagctcttgattccactgcgcacttccatgcccttctacaattcagaggaagaacggcagcatggcctgcagcagctgcagcagcggcagaagtatttgattgaattctgctacaccatagcccagaaatacctctttgaagggaaacacgaagatgctgtaccagcagctttgcagtcccttcgcttccgtgtgaagctgtatggcctgagctccgtagagcttgtgcctgcttacctgctgttggccgaggccagccttggtctgggccgaatcgttcaggctgaagaatatctattccaagcccagtggacagtcctcaaatcaactgactgtagtaatgccacccactctttactgcatcggaatctgggacttctctatatagctaagaaaaactatgaagaggcccgttatcatctggccaatgatgtaaacaagctaagttataacacctgtatatttccaaaatctaaattataacacctgtatatttccaaaa

SEQ ID NO: 304028 - DNA, 1584 bp, Homo sapiens
ttggttcaaaacatttaatggatagaaaaaacatttaatgcttacccatttctcaccagattaagtgcacatgccacaaccagtcattaaaggctttttctagtctaaattcctgttcttcaaacgtcaaaccgcccttctactctactgacctgaaacacacagcctcaccctccacatctctgcagacccaccgcatttgccacctgccctagggagcttttcctgatcttacctcggatgcctttcactgctcccacatctgaattcctttaactcactccatgtttttctcaaaggcagaccaaggtatttatgcaaacatggtgtctccctagtcttgggtgaggtctttgacatcactcactgcagcgattcatctcccctactctgcactgtcagactctaaagaagggtgcaacaaatacttgtccatttagactgccggcaaaccctgagagcaggaattttggccttttgtatctccagtgcctagaacagtgcttggtacacagtaggcactcattcattgaacgttgctgaaggaattgaacgtacatactacaagccctgcagatgcagatacaggaggggttgacggcacagtgcttagggtggaactggaggcaccacctctcctgaggggtgatgcgccgcttcctgggcaggctcgggggagctcgctcaaatgcctgcctctctgtagcccaaacgctggaaaaaaaaatactcacaaatcacctatccaagtatgtacacacaggctcacttaaacccgccctattaaaaaaatatacacacgcacacaccatttatccaagtatgtatacacgggcttgcttaaacctgccctattaaaaataataatgtatatatttatgcacgaacatacacacatatatctatccaggtctgtacatagacttgcttaaacctgccctattaaatacagacacacacccctatccaggtatgtacatacatatataatatataaatataaagacatatatatgcacagacttaactccaacacgattggagtgtcgggagggcaactgggctgccctctccgccctccaggactgcgggacaagtctcccggcgcccgggtcgcaggagacccggagccctaaaacggcccctgcgcggcttgggccttccggctttccgtccgccgcggccgccattggctgggttcggcgcagctaacagacggcggcagtgcgagaaagccgaagatggcggtccccgcggcgctgatcctacgggagagccccaggtagctgatccgttaagctcttgcggtagccgcgcccaggaaggcccagatcgggctcgcacaaggctgtccttgctgcctgccgcctgggcgccgcggcgggcccggttgagtggggtggggtggggtgggctgccgaggttgcgacgctgcgtctgcggagtgcgtggggccgtgtagcgcctctacagtcacggtggtccacctgtggggctcacagtgcgcctggcagctgaggtctgtacggaagcgtgtggtctgcaagcgtggggtctgcgtcactgttcgcggagtttggtatc

SEQ ID NO: 304029 - DNA, 298 bp, Homo sapiens
tcgctctgggatccccatcgcgaatcaccaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccagctactgcagccgtggaactaagtgtggctaatgaatg

SEQ ID NO: 304030 - DNA, 2646 bp, Homo sapiens
ttggttcaaaacatttaatggatagaaaaaacatttaatgcttacccatttctcaccagattaagtgcacatgccacaaccagtcattaaaggctttttctagtctaaattcctgttcttcaaacgtcaaaccgcccttctactctactgacctgaaacacacagcctcaccctccacatctctgcagacccaccgcatttgccacctgccctagggagcttttcctgatcttacctcggatgcctttcactgctcccacatctgaattcctttaactcactccatgtttttctcaaaggcagaccaaggtatttatgcaaacatggtgtctccctagtcttgggtgaggtctttgacatcactcactgcagcgattcatctcccctactctgcactgtcagactctaaagaagggtgcaacaaatacttgtccatttagactgccggcaaaccctgagagcaggaattttggccttttgtatctccagtgcctagaacagtgcttggtacacagtaggcactcattcattgaacgttgctgaaggaattgaacgtacatactacaagccctgcagatgcagatacaggaggggttgacggcacagtgcttagggtggaactggaggcaccacctctcctgaggggtgatgcgccgcttcctgggcaggctcgggggagctcgctcaaatgcctgcctctctgtagcccaaacgctggaaaaaaaaatactcacaaatcacctatccaagtatgtacacacaggctcacttaaacccgccctattaaaaaaatatacacacgcacacaccatttatccaagtatgtatacacgggcttgcttaaacctgccctattaaaaataataatgtatatatttatgcacgaacatacacacatatatctatccaggtctgtacatagacttgcttaaacctgccctattaaatacagacacacacccctatccaggtatgtacatacatatataatatataaatataaagacatatatatgcacagacttaactccaacacgattggagtgtcgggagggcaactgggctgccctctccgccctccaggactgcgggacaagtctcccggcgcccgggtcgcaggagacccggagccctaaaacggcccctgcgcggcttgggccttccggctttccgtccgccgcggccgccattggctgggttcggcgcagctaacagacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagactgttggatggcagcttaaccttcagatggctcactctgctcaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttag

SEQ ID NO: 304031 - DNA, 2690 bp, Homo sapiens
  misc_feature (2680)..(2680): n is a, c, g, or t
ttggttcaaaacatttaatggatagaaaaaacatttaatgcttacccatttctcaccagattaagtgcacatgccacaaccagtcattaaaggctttttctagtctaaattcctgttcttcaaacgtcaaaccgcccttctactctactgacctgaaacacacagcctcaccctccacatctctgcagacccaccgcatttgccacctgccctagggagcttttcctgatcttacctcggatgcctttcactgctcccacatctgaattcctttaactcactccatgtttttctcaaaggcagaccaaggtatttatgcaaacatggtgtctccctagtcttgggtgaggtctttgacatcactcactgcagcgattcatctcccctactctgcactgtcagactctaaagaagggtgcaacaaatacttgtccatttagactgccggcaaaccctgagagcaggaattttggccttttgtatctccagtgcctagaacagtgcttggtacacagtaggcactcattcattgaacgttgctgaaggaattgaacgtacatactacaagccctgcagatgcagatacaggaggggttgacggcacagtgcttagggtggaactggaggcaccacctctcctgaggggtgatgcgccgcttcctgggcaggctcgggggagctcgctcaaatgcctgcctctctgtagcccaaacgctggaaaaaaaaatactcacaaatcacctatccaagtatgtacacacaggctcacttaaacccgccctattaaaaaaatatacacacgcacacaccatttatccaagtatgtatacacgggcttgcttaaacctgccctattaaaaataataatgtatatatttatgcacgaacatacacacatatatctatccaggtctgtacatagacttgcttaaacctgccctattaaatacagacacacacccctatccaggtatgtacatacatatataatatataaatataaagacatatatatgcacagacttaactccaacacgattggagtgtcgggagggcaactgggctgccctctccgccctccaggactgcgggacaagtctcccggcgcccgggtcgcaggagacccggagccctaaaacggcccctgcgcggcttgggccttccggctttccgtccgccgcggccgccattggctgggttcggcgcagctaacagacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagactgttggatggcagcttaaccttcagatggctcactctgctcaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttagaaaaaaaaaaatggcctttgcctacgggagcttncgccttcctt

SEQ ID NO: 304032 - DNA, 3072 bp, Homo sapiens
ttggttcaaaacatttaatggatagaaaaaacatttaatgcttacccatttctcaccagattaagtgcacatgccacaaccagtcattaaaggctttttctagtctaaattcctgttcttcaaacgtcaaaccgcccttctactctactgacctgaaacacacagcctcaccctccacatctctgcagacccaccgcatttgccacctgccctagggagcttttcctgatcttacctcggatgcctttcactgctcccacatctgaattcctttaactcactccatgtttttctcaaaggcagaccaaggtatttatgcaaacatggtgtctccctagtcttgggtgaggtctttgacatcactcactgcagcgattcatctcccctactctgcactgtcagactctaaagaagggtgcaacaaatacttgtccatttagactgccggcaaaccctgagagcaggaattttggccttttgtatctccagtgcctagaacagtgcttggtacacagtaggcactcattcattgaacgttgctgaaggaattgaacgtacatactacaagccctgcagatgcagatacaggaggggttgacggcacagtgcttagggtggaactggaggcaccacctctcctgaggggtgatgcgccgcttcctgggcaggctcgggggagctcgctcaaatgcctgcctctctgtagcccaaacgctggaaaaaaaaatactcacaaatcacctatccaagtatgtacacacaggctcacttaaacccgccctattaaaaaaatatacacacgcacacaccatttatccaagtatgtatacacgggcttgcttaaacctgccctattaaaaataataatgtatatatttatgcacgaacatacacacatatatctatccaggtctgtacatagacttgcttaaacctgccctattaaatacagacacacacccctatccaggtatgtacatacatatataatatataaatataaagacatatatatgcacagacttaactccaacacgattggagtgtcgggagggcaactgggctgccctctccgccctccaggactgcgggacaagtctcccggcgcccgggtcgcaggagacccggagccctaaaacggcccctgcgcggcttgggccttccggctttccgtccgccgcggccgccattggctgggttcggcgcagctaacagacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagactgttggatggcagcttaaccttcagatggctcactctgctcaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttagattggttgaagtgtacattttttaattatatacattatagtatattttatgccatgaatgtatgtaaatgaatacatttacgtacatttgttaaaatgtatgtaatgaatacatttacatacatttgtttaaaaaaaacttgaattttttatgaatgaaatttctgtattgtttccaaaaagagagagattcaaacatgacttgcttcacatgaagaaatttgatttcagaaatgtcctatatttaaataagcaaagccattgaaattgaagcacatttcttatttgaagcatctgggaaatacaactgttaagtatctctcaaatattcagtatatggaatttatacccacatttgtttgtatatctatttgtaagctgttgcttagaagaattgagagtttggattatttcagaatacaactat

SEQ ID NO: 304033 - DNA, 2624 bp, Homo sapiens
ttggttcaaaacatttaatggatagaaaaaacatttaatgcttacccatttctcaccagattaagtgcacatgccacaaccagtcattaaaggctttttctagtctaaattcctgttcttcaaacgtcaaaccgcccttctactctactgacctgaaacacacagcctcaccctccacatctctgcagacccaccgcatttgccacctgccctagggagcttttcctgatcttacctcggatgcctttcactgctcccacatctgaattcctttaactcactccatgtttttctcaaaggcagaccaaggtatttatgcaaacatggtgtctccctagtcttgggtgaggtctttgacatcactcactgcagcgattcatctcccctactctgcactgtcagactctaaagaagggtgcaacaaatacttgtccatttagactgccggcaaaccctgagagcaggaattttggccttttgtatctccagtgcctagaacagtgcttggtacacagtaggcactcattcattgaacgttgctgaaggaattgaacgtacatactacaagccctgcagatgcagatacaggaggggttgacggcacagtgcttagggtggaactggaggcaccacctctcctgaggggtgatgcgccgcttcctgggcaggctcgggggagctcgctcaaatgcctgcctctctgtagcccaaacgctggaaaaaaaaatactcacaaatcacctatccaagtatgtacacacaggctcacttaaacccgccctattaaaaaaatatacacacgcacacaccatttatccaagtatgtatacacgggcttgcttaaacctgccctattaaaaataataatgtatatatttatgcacgaacatacacacatatatctatccaggtctgtacatagacttgcttaaacctgccctattaaatacagacacacacccctatccaggtatgtacatacatatataatatataaatataaagacatatatatgcacagacttaactccaacacgattggagtgtcgggagggcaactgggctgccctctccgccctccaggactgcgggacaagtctcccggcgcccgggtcgcaggagacccggagccctaaaacggcccctgcgcggcttgggccttccggctttccgtccgccgcggccgccattggctgggttcggcgcaggaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagactgttggatggcagcttaaccttcagatggctcactctgctcaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttag

SEQ ID NO: 304034 - DNA, 1497 bp, Homo sapiens
gacactctggtgggaaaggctcacgctgctgctggagggtctttaatagccaacatgtgttaataccccttttaaatcagtatcgaataggggaccgaatttttggttggtagaagaatctagcctggctttgcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagactgttggatggcagcttaaccttcagatggctcactctgctcaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttag

SEQ ID NO: 304035 - DNA, 2592 bp, Homo sapiens
ttggttcaaaacatttaatggatagaaaaaacatttaatgcttacccatttctcaccagattaagtgcacatgccacaaccagtcattaaaggctttttctagtctaaattcctgttcttcaaacgtcaaaccgcccttctactctactgacctgaaacacacagcctcaccctccacatctctgcagacccaccgcatttgccacctgccctagggagcttttcctgatcttacctcggatgcctttcactgctcccacatctgaattcctttaactcactccatgtttttctcaaaggcagaccaaggtatttatgcaaacatggtgtctccctagtcttgggtgaggtctttgacatcactcactgcagcgattcatctcccctactctgcactgtcagactctaaagaagggtgcaacaaatacttgtccatttagactgccggcaaaccctgagagcaggaattttggccttttgtatctccagtgcctagaacagtgcttggtacacagtaggcactcattcattgaacgttgctgaaggaattgaacgtacatactacaagccctgcagatgcagatacaggaggggttgacggcacagtgcttagggtggaactggaggcaccacctctcctgaggggtgatgcgccgcttcctgggcaggctcgggggagctcgctcaaatgcctgcctctctgtagcccaaacgctggaaaaaaaaatactcacaaatcacctatccaagtatgtacacacaggctcacttaaacccgccctattaaaaaaatatacacacgcacacaccatttatccaagtatgtatacacgggcttgcttaaacctgccctattaaaaataataatgtatatatttatgcacgaacatacacacatatatctatccaggtctgtacatagacttgcttaaacctgccctattaaatacagacacacacccctatccaggtatgtacatacatatataatatataaatataaagacatatatatgcacagacttaactccaacacgattggagtgtcgggagggcaactgggctgccctctccgccctccaggactgcgggacaagtctcccggcgcccgggtcgcaggagacccggagccctaaaacggcccctgcgcggcttgggccttccggctttccgtccgccgcggccgccattggctgggttcggcgcagctaacagacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgagcttaaccttcagatggctcactctgctcaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttag

SEQ ID NO: 304036 - DNA, 2587 bp, Homo sapiens
ttggttcaaaacatttaatggatagaaaaaacatttaatgcttacccatttctcaccagattaagtgcacatgccacaaccagtcattaaaggctttttctagtctaaattcctgttcttcaaacgtcaaaccgcccttctactctactgacctgaaacacacagcctcaccctccacatctctgcagacccaccgcatttgccacctgccctagggagcttttcctgatcttacctcggatgcctttcactgctcccacatctgaattcctttaactcactccatgtttttctcaaaggcagaccaaggtatttatgcaaacatggtgtctccctagtcttgggtgaggtctttgacatcactcactgcagcgattcatctcccctactctgcactgtcagactctaaagaagggtgcaacaaatacttgtccatttagactgccggcaaaccctgagagcaggaattttggccttttgtatctccagtgcctagaacagtgcttggtacacagtaggcactcattcattgaacgttgctgaaggaattgaacgtacatactacaagccctgcagatgcagatacaggaggggttgacggcacagtgcttagggtggaactggaggcaccacctctcctgaggggtgatgcgccgcttcctgggcaggctcgggggagctcgctcaaatgcctgcctctctgtagcccaaacgctggaaaaaaaaatactcacaaatcacctatccaagtatgtacacacaggctcacttaaacccgccctattaaaaaaatatacacacgcacacaccatttatccaagtatgtatacacgggcttgcttaaacctgccctattaaaaataataatgtatatatttatgcacgaacatacacacatatatctatccaggtctgtacatagacttgcttaaacctgccctattaaatacagacacacacccctatccaggtatgtacatacatatataatatataaatataaagacatatatatgcacagacttaactccaacacgattggagtgtcgggagggcaactgggctgccctctccgccctccaggactgcgggacaagtctcccggcgcccgggtcgcaggagacccggagccctaaaacggcccctgcgcggcttgggccttccggctttccgtccgccgcggccgccattggctgggttcggcgcagctaacagacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagactgttggatggcagcttaaccttcagatggctcactctgctcaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttag

SEQ ID NO: 304037 - DNA, 2535 bp, Homo sapiens
ttggttcaaaacatttaatggatagaaaaaacatttaatgcttacccatttctcaccagattaagtgcacatgccacaaccagtcattaaaggctttttctagtctaaattcctgttcttcaaacgtcaaaccgcccttctactctactgacctgaaacacacagcctcaccctccacatctctgcagacccaccgcatttgccacctgccctagggagcttttcctgatcttacctcggatgcctttcactgctcccacatctgaattcctttaactcactccatgtttttctcaaaggcagaccaaggtatttatgcaaacatggtgtctccctagtcttgggtgaggtctttgacatcactcactgcagcgattcatctcccctactctgcactgtcagactctaaagaagggtgcaacaaatacttgtccatttagactgccggcaaaccctgagagcaggaattttggccttttgtatctccagtgcctagaacagtgcttggtacacagtaggcactcattcattgaacgttgctgaaggaattgaacgtacatactacaagccctgcagatgcagatacaggaggggttgacggcacagtgcttagggtggaactggaggcaccacctctcctgaggggtgatgcgccgcttcctgggcaggctcgggggagctcgctcaaatgcctgcctctctgtagcccaaacgctggaaaaaaaaatactcacaaatcacctatccaagtatgtacacacaggctcacttaaacccgccctattaaaaaaatatacacacgcacacaccatttatccaagtatgtatacacgggcttgcttaaacctgccctattaaaaataataatgtatatatttatgcacgaacatacacacatatatctatccaggtctgtacatagacttgcttaaacctgccctattaaatacagacacacacccctatccaggtatgtacatacatatataatatataaatataaagacatatatatgcacagacttaactccaacacgattggagtgtcgggagggcaactgggctgccctctccgccctccaggactgcgggacaagtctcccggcgcccgggtcgcaggagacccggagccctaaaacggcccctgcgcggcttgggccttccggctttccgtccgccgcggccgccattggctgggttcggcgcagctaacagacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttag

SEQ ID NO: 304038 - DNA, 954 bp, Homo sapiens
gttgtaattaatagtgatggttgttagtttgtatgtcactataaaccttcatacctggcagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttag

SEQ ID NO: 304039 - DNA, 897 bp, Homo sapiens
ctgatcctgcagaagtactcgtgtagtaccattcacattgagctgtgtgatttcttgactctctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttag

SEQ ID NO: 304040 - DNA, 1864 bp, Homo sapiens
  misc_feature (1760)..(1760): n is a, c, g, or t
ttggttcaaaacatttaatggatagaaaaaacatttaatgcttacccatttctcaccagattaagtgcacatgccacaaccagtcattaaaggctttttctagtctaaattcctgttcttcaaacgtcaaaccgcccttctactctactgacctgaaacacacagcctcaccctccacatctctgcagacccaccgcatttgccacctgccctagggagcttttcctgatcttacctcggatgcctttcactgctcccacatctgaattcctttaactcactccatgtttttctcaaaggcagaccaaggtatttatgcaaacatggtgtctccctagtcttgggtgaggtctttgacatcactcactgcagcgattcatctcccctactctgcactgtcagactctaaagaagggtgcaacaaatacttgtccatttagactgccggcaaaccctgagagcaggaattttggccttttgtatctccagtgcctagaacagtgcttggtacacagtaggcactcattcattgaacgttgctgaaggaattgaacgtacatactacaagccctgcagatgcagatacaggaggggttgacggcacagtgcttagggtggaactggaggcaccacctctcctgaggggtgatgcgccgcttcctgggcaggctcgggggagctcgctcaaatgcctgcctctctgtagcccaaacgctggaaaaaaaaatactcacaaatcacctatccaagtatgtacacacaggctcacttaaacccgccctattaaaaaaatatacacacgcacacaccatttatccaagtatgtatacacgggcttgcttaaacctgccctattaaaaataataatgtatatatttatgcacgaacatacacacatatatctatccaggtctgtacatagacttgcttaaacctgccctattaaatacagacacacacccctatccaggtatgtacatacatatataatatataaatataaagacatatatatgcacagacttaactccaacacgattggagtgtcgggagggcaactgggctgccctctccgccctccaggactgcgggacaagtctcccggcgcccgggtcgcaggagacccggagccctaaaacggcccctgcgcggcttgggccttccggctttccgtccgccgcggccgccattggctgggttcggcgcagctaacagacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagactgttggatggcagcttaaccttcagatggctcactctgctcaagcaaaactaaaatctcctcaagctgtgttacaactcggagtgaacaatgaagattcaaagagagccctnggagaaaagttcttggtggaaattcagtcccaagggagttggttggatttcctattaacacggctttgaggacttttcaaactcccacggtggatttccccttc

SEQ ID NO: 304041 - DNA, 2291 bp, Homo sapiens
ttggttcaaaacatttaatggatagaaaaaacatttaatgcttacccatttctcaccagattaagtgcacatgccacaaccagtcattaaaggctttttctagtctaaattcctgttcttcaaacgtcaaaccgcccttctactctactgacctgaaacacacagcctcaccctccacatctctgcagacccaccgcatttgccacctgccctagggagcttttcctgatcttacctcggatgcctttcactgctcccacatctgaattcctttaactcactccatgtttttctcaaaggcagaccaaggtatttatgcaaacatggtgtctccctagtcttgggtgaggtctttgacatcactcactgcagcgattcatctcccctactctgcactgtcagactctaaagaagggtgcaacaaatacttgtccatttagactgccggcaaaccctgagagcaggaattttggccttttgtatctccagtgcctagaacagtgcttggtacacagtaggcactcattcattgaacgttgctgaaggaattgaacgtacatactacaagccctgcagatgcagatacaggaggggttgacggcacagtgcttagggtggaactggaggcaccacctctcctgaggggtgatgcgccgcttcctgggcaggctcgggggagctcgctcaaatgcctgcctctctgtagcccaaacgctggaaaaaaaaatactcacaaatcacctatccaagtatgtacacacaggctcacttaaacccgccctattaaaaaaatatacacacgcacacaccatttatccaagtatgtatacacgggcttgcttaaacctgccctattaaaaataataatgtatatatttatgcacgaacatacacacatatatctatccaggtctgtacatagacttgcttaaacctgccctattaaatacagacacacacccctatccaggtatgtacatacatatataatatataaatataaagacatatatatgcacagacttaactccaacacgattggagtgtcgggagggcaactgggctgccctctccgccctccaggactgcgggacaagtctcccggcgcccgggtcgcaggagacccggagccctaaaacggcccctgcgcggcttgggccttccggctttccgtccgccgcggccgccattggctgggttcggcgcagctaacagacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagactgttggatggcagcttaaccttcagatggctcactctgctcaagcaaaactaaaatctcctcaagctgtgttacaactcggagtgaacaatgaagattcaaagggtaagaaatggtatcccattaaaaggatgtattttgtttgttaggacttaaactttttattcttagcagtctttgctctctggatttagaatttaaacataattcagttaaacagttattaataagtggatcttttttgacagaaatagcttatcttgcaaggtgcctttcttacaaaaacatttcataatgtcttcttttaaattctgcagtgaaaaaaaattgttgaagaccatataaaattatgattttaatgttttaggtatttgcagatattcctgagtgtttcatgttttaagctgaatatatgtggtagagagaatattgtttgttgtccagctagagcctggaacaataaatatgatggtgacctgaattgtgtttttgtgtgtgtagtagtatagtatgcctgcatgtgtttaaatcccagctacttgggaggcagaagaatggcatgaacccgggaggtggagcttgcaatgagccgagatcctgccactgcaatccagcccgggtgacagaatgagactccatctcaa

SEQ ID NO: 304042 - DNA, 1102 bp, Homo sapiens
gtggggggcgggggcggcacgtgccgccgctctcggccaatgcggagccccgcgcggaggtcacgtgcctctgtttggcgcttttgtgcgcgcccgggtctgttggtgctcagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304043 - DNA, 1006 bp, Homo sapiens
  misc_feature (39)..(39): n is a, c, g, or t
ggacgcgtgggtccggacgcgtgggttggcggctcggantgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304044 - DNA, 951 bp, Homo sapiens
gggaaaaagtatactaccgggtcgacggtcttcaatggggcaagggcttatgactgagtatgcaagatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304045 - DNA, 930 bp, Homo sapiens
  misc_feature (891)..(891): n is a, c, g, or t
  misc_feature (898)..(898): n is a, c, g, or t
  misc_feature (901)..(901): n is a, c, g, or t
ccctgaccgggcctaacggagcgaggacccggggtaatgccgaggggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatgattntggggtnttnacgcgtaatgccgattcgtttctttaccc

SEQ ID NO: 304046 - DNA, 932 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304047 - DNA, 1550 bp, Homo sapiens
gtggggggcgggggcggcacgtgccgccgctctcggccaatgcggagccccgcgcggaggtcacgtgcctctgtttggcgcttttgtgcgcgcccgggtctgttggtgctcagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgta

SEQ ID NO: 304048 - DNA, 829 bp, Homo sapiens
gtggggggcgggggcggcacgtgccgccgctctcggccaatgcggagccccgcgcggaggtcacgtgcctctgtttggcgcttttgtgcgcgcccgggtctgttggtgctcagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaaggtaaacgaagcaattcacagaaagcaggatattaatttatgtaatgggcagatcaattttatttctataacaggaagaaaacagaattgtagctacactgtgattattacatatgccagtgactggaaggaaataccagtcctcatttattgaactcctgttacatgcccgctcctttgtttatatttttctcctttaatacatggtgttgcctcaaataatggaaattagaaacagtttcaggaatgttaagtcgtttttctgcagtcatacaactagtaagtgttggggtcagaattcaagccctggtctatcttaaaccaaagctcatgcttctctcatgcttcctctttgaaaagatttgttgccagatgattctttggcactttggttttgttttttgagagctgtacaataacattttaaattgctagtgtga

SEQ ID NO: 304049 - DNA, 858 bp, Homo sapiens
  misc_feature (21)..(21): n is a, c, g, or t
aattcgcggccgcgtcgacangacagaaggggagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304050 - DNA, 881 bp, Homo sapiens
  misc_feature (646)..(646): n is a, c, g, or t
  misc_feature (673)..(673): n is a, c, g, or t
gataatctccttgggggtctctgaccgtgctgggatggggctcccatctctggtaagattgtagcatcaatacacatagactgtcagctagtattctattcacacatggacttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttcacaaaatggaagctantaaagagaaccgagaggcacaaatggntgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactgggcaagaggtcaaaaaaataaaaaacctacggacaaaactgtagaagcc

SEQ ID NO: 304051 - DNA, 871 bp, Homo sapiens
  misc_feature (21)..(21): n is a, c, g, or t
aattcgcggccgcgtcgacangacagaaggggagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgatctaattcaagatgttcgcaggtcatttattctcctcctaccaaatgcaagacggtacgtaggaagatggttgaccggaccagacggtggagtgtcaggacaaggggcactgagtgctccctacaaaagcggcccaagcactccgacgtctacaagcaacaaccggggcggcaggcacgcgggcggacccttgaagatagggacagacgacatcactgaacgcaaccaacgccacacaggaccaaacacaaacaggaaaggaaacacacagccacgaca

SEQ ID NO: 304052 - DNA, 1009 bp, Homo sapiens
ttgggggggggggacaaacttacggctaggtacgaggctgggtgtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatctttgtggcaggttgtggggccttgagcgggaggggttgtcctttaccccttgccttcgagccggcgggggaacgcgggtcaaaaaaaaccgctttgtgggggggggcgggttccctagtg

SEQ ID NO: 304053 - DNA, 1020 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304054 - DNA, 1468 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgta

SEQ ID NO: 304055 - DNA, 1582 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtaaaaaaacaacaacaacccccccaccaccgacaacccccccccaccaccccccccccacaccccccccaaacccgcgatccacacccgcgcacccacccacccggccttaccgcc

SEQ ID NO: 304056 - DNA, 1512 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtacaactcctgtgaaatgactaaagggaaccttaattatttctaaa

SEQ ID NO: 304057 - DNA, 2089 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtaaaaaaaaaaaaaaaaaaaaaaaaaaaaacacttttctggcgcgcgccttgggccctctgaaaaacgtttttataacccatttctttgggcgccggggccccacggtggtatagcggagacacctgggtcaaatagcgtgtccatggagagaaaactcggcgggccacgaaccaacaggcggcgctgggacatcctccccccaaatataaaaaaagcgcccccggggccaaacacccagcaagcggtttctgagaaacacaatctctccaaaatgggattctcggggagccccccatccacggggacactcttattacaaaagaggaggacctcccacaagggaagagcctcgcaataatactacgaatctaaaacgcccccacaatcgctgtggtacccatcctcacaaaccaaacaaaacgaaccaagcgagcgtaaaaaaggatgacagtaagcaggcgcaaaaacgacaacaggacgcaccgagacgacaacaaaaaggagctggcgagcacgccgttgcgccgacagcgaagagggccagccaaagcgcgagggagcatagacggttcagcccgaagaagcggaagacgcgcgacacgcaggcgcagcacacacgcc

SEQ ID NO: 304058 - DNA, 1561 bp, Homo sapiens
  misc_feature (23)..(23): n is a, c, g, or t
  misc_feature (26)..(26): n is a, c, g, or t
  misc_feature (1533)..(1533): n is a, c, g, or t
  misc_feature (1550)..(1551): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtaaaaaaaaaaaaaaaaaaaaaaaaaaaaaaaaaaaaaaaaaaaaaaaaaaaaaaccacaaacaaanaaataaacaacaaaaannagagggggcg

SEQ ID NO: 304059 - DNA, 1389 bp, Homo sapiens
  misc_feature (23)..(23): n is a, c, g, or t
  misc_feature (26)..(26): n is a, c, g, or t
  misc_feature (1323)..(1323): n is a, c, g, or t
  misc_feature (1336)..(1336): n is a, c, g, or t
  misc_feature (1362)..(1362): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaaagggcagaatttaaaaaagccacaaancgttgttttcctnagaaaaaaacaagtttgaaaaaaaanaaatcctccaagaattccttacctttg

SEQ ID NO: 304060 - DNA, 1024 bp, Homo sapiens
ccctgaccgggcctaacggagcgaggacccggggtaatgccgaggggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304061 - DNA, 1359 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttaaaaaaaaaaaaaaaaaaaaaaaaaaaaaaaaaaaaaaaaaaaaaaaaaaaaacaaaaaaaaaaatacacaaaaaaagcaccaaaaaataaaacacaacaaaaagaaataaaatcagacaacaagcgactgtaacctcagaaaataaagcaaaggttggcagaagtcgaatagttaattcacgcacgcaggatcacaccataagtgaccaccgagacaacctctcgtatcagcgaggcgctttcctcaaatagggccccatatctcacacgcagagacgccagctccggcaaccacatcttagataataacattaccgccgcactagcattggaccgcc

SEQ ID NO: 304062 - DNA, 1059 bp, Homo sapiens
  misc_feature (23)..(23): n is a, c, g, or t
  misc_feature (26)..(26): n is a, c, g, or t
  misc_feature (1031)..(1031): n is a, c, g, or t
  misc_feature (1048)..(1049): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttcacaaacaaanaaataaacaacaaaaannagagggggcg

SEQ ID NO: 304063 - DNA, 1123 bp, Homo sapiens
  misc_feature (23)..(23): n is a, c, g, or t
  misc_feature (26)..(26): n is a, c, g, or t
  misc_feature (1097)..(1097): n is a, c, g, or t
  misc_feature (1108)..(1108): n is a, c, g, or t
  misc_feature (1112)..(1112): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttaaaaaaaaaaaaaaaaaaaaaaaaaaaaaaaaaaaaaaaaaaaaaaaaaaaaaaaaaaaaaaacaaaaaaaaaaaanaaaaaaaaaanaagnaaaaaagaaaa

SEQ ID NO: 304064 - DNA, 1117 bp, Homo sapiens
  misc_feature (23)..(23): n is a, c, g, or t
  misc_feature (26)..(26): n is a, c, g, or t
  misc_feature (1091)..(1091): n is a, c, g, or t
  misc_feature (1102)..(1102): n is a, c, g, or t
  misc_feature (1106)..(1106): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttaaaaaaaaaaaaaaaaaaaaaaaaaaaaaaaaaaaaaaaaaaaaaaaaaaaaaaaaacaaaaaaaaaaaanaaaaaaaaaanaagnaaaaaagaaaa

SEQ ID NO: 304065 - DNA, 1015 bp, Homo sapiens
  misc_feature (23)..(23): n is a, c, g, or t
  misc_feature (26)..(26): n is a, c, g, or t
  misc_feature (945)..(945): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatcctttgtgacaggttgttgggtcttgacgtagatgtgatattgtctttaatccatttgtccanttcagagtaggtgaggttaacggcgggggggttaaaataaaaaaactcgttttgggggagagagagggtc

SEQ ID NO: 304066 - DNA, 914 bp, Homo sapiens
tcgagctcgttacccgtcctacatagtgtatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304067 - DNA, 1003 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatctttgtggcaggttgtggggccttgagcgggaggggttgtcctttaccccttgccttcgagccggcgggggaacgcgggtcaaaaaaaaccgctttgtgggggggggcgggttccctagtg

SEQ ID NO: 304068 - DNA, 926 bp, Homo sapiens
  misc_feature (23)..(23): n is a, c, g, or t
  misc_feature (26)..(26): n is a, c, g, or t
  misc_feature (887)..(887): n is a, c, g, or t
  misc_feature (894)..(894): n is a, c, g, or t
  misc_feature (897)..(897): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatgattntggggtnttnacgcgtaatgccgattcgtttctttaccc

SEQ ID NO: 304069 - DNA, 1146 bp, Homo sapiens
  misc_feature (23)..(23): n is a, c, g, or t
  misc_feature (26)..(26): n is a, c, g, or t
  misc_feature (1145)..(1145): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgagacgcagtgggtccgggaaaccttttggttgaacgaagatatgtgggggggcgtgaacaggttaatcgggagaaatcggttccgtttaaagacccacatatgtgccaacattccaagaacagggcagttcagggtagtagaagacgggcggtgagcaaaaaaggggggggcagataaatggggaggaagcaagacgtgttaagtactagagtatacaatatggaggaagtggaagcgaataagaagcgtgtgtagtatgaaattactagtctatgcgtattttttcttggtgatgttaana

SEQ ID NO: 304070 - DNA, 971 bp, Homo sapiens
  misc_feature (23)..(23): n is a, c, g, or t
  misc_feature (26)..(26): n is a, c, g, or t
  misc_feature (846)..(846): n is a, c, g, or t
  misc_feature (856)..(856): n is a, c, g, or t
  misc_feature (866)..(866): n is a, c, g, or t
  misc_feature (868)..(868): n is a, c, g, or t
  misc_feature (870)..(870): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgcngctaggctancgtttggtcngnanaccttttgcaacacgctgtcggccttgaacggaaagcgactttgtccttcaccttgcccctccagccggcgggtacccccgctggggcgaaaaagggccac

SEQ ID NO: 304071 - DNA, 857 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaacattttattttttccctccatgacaaatattttagaagctaatgtaggactgtataggtagatccagatccagactgtaagatgttgttttaggggctaaaaa

SEQ ID NO: 304072 - DNA, 1313 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgta

SEQ ID NO: 304073 - DNA, 995 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304074 - DNA, 865 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304075 - DNA, 1303 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgta

SEQ ID NO: 304076 - DNA, 964 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgaattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304077 - DNA, 911 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttgtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304078 - DNA, 1527 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttgtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttaaaaaaaaaaaaaaaaaaaaaaaaaaaaaaaaaaaaaaaaaaaaaaaaaaaaaccggggggctcttatgtgggggggcggcggaaaaaagacggggatcaagagaagaggaggacaggtgggtcatcagatggtgttacggtagaccaccattttgtgcgtgtaccagagcggggtcaaaccgccgggggctacccccaaagagggggaggcggataatacatcggcgaaaaacgccgggtgtttaatcgcggttttagtgacttcgccggacacacaaacaccaacgaaccaacaaacaatagacgaaaagagcaaccgacgaagaagacaacagaccaaaaaacacaaacaaagatagaaacgaaccacgcaacaaaaaagcaagcgaatgacacacatcccaaaccagtacaaaaaacaacaacaagcaaacaaagcgagaaacaaaccaaaaaagaaaaacgaacaaccacaaagaaacaacaaaaagacaggaaagagaagaaagaaagaaagaagacaagagaaacaagaaacaacgccgacagcaaaagaaagaagaaagaacagagaagaagagaacacggacgacacacaacagagacaacaaaagg

SEQ ID NO: 304079 - DNA, 897 bp, Homo sapiens
  misc_feature (23)..(23): n is a, c, g, or t
  misc_feature (26)..(26): n is a, c, g, or t
  misc_feature (662)..(662): n is a, c, g, or t
  misc_feature (689)..(689): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttcacaaaatggaagctantaaagagaaccgagaggcacaaatggntgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactgggcaagaggtcaaaaaaataaaaaacctacggacaaaactgtagaagcc

SEQ ID NO: 304080 - DNA, 1197 bp, Homo sapiens
tcgagctcgttacccgtcctacatagtgtatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgta

SEQ ID NO: 304081 - DNA, 855 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgtt

SEQ ID NO: 304082 - DNA, 966 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgta

SEQ ID NO: 304083 - DNA, 589 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggttggtttcttactttgtaaaagggttgagcttggagtttgatgcaccaatgagttggcttgaactaagtgctttgataaaaggtgttt

SEQ ID NO: 304084 - DNA, 581 bp, Homo sapiens
  misc_feature (23)..(23): n is a, c, g, or t
  misc_feature (26)..(26): n is a, c, g, or t
  misc_feature (512)..(512): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaagataagcacattnaagaagtgcggaagaacagccctcggataaaccttggtggaccagcctgagtcatgtgcccacccctca

SEQ ID NO: 304085 - DNA, 798 bp, Homo sapiens
  misc_feature (23)..(23): n is a, c, g, or t
  misc_feature (26)..(26): n is a, c, g, or t
aaacccatatggcaggacgaggncgnggtgaattggccgagggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaacattttattttttccctccatgacaaatattttagaagctaatgtaggactgtataggtagatccagatccagactgtaagatgttgttttaggggctaaaaa

SEQ ID NO: 304086 - DNA, 4125 bp, Homo sapiens
cagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctggtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgatgggggatgagcctgaagggattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaaatgtgtccc

SEQ ID NO: 304087 - DNA, 4104 bp, Homo sapiens
cagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctggtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaaatgtgtccc

SEQ ID NO: 304088 - DNA, 3919 bp, Homo sapiens
cagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctggtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaaatgtgtccc

SEQ ID NO: 304089 - DNA, 4256 bp, Homo sapiens
cagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctggtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggcacctgccagctctctcccttgggccttctacctggagcaggaggcagaatcccattctcctagggagtctgtgtatattcactgcccaggagtgttccagcagattgccccatcaggtgccccagccccatcttttctgtttgggccacagtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaaatgtgtccc

SEQ ID NO: 304090 - DNA, 3315 bp, Homo sapiens
gcaggtgatctagaggatcccatctcaggcaggacgaccgtgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaaatgtgtccc

SEQ ID NO: 304091 - DNA, 2898 bp, Homo sapiens
  misc_feature (2885)..(2886): n is a, c, g, or t
cagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctggtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagctggagtnngagcagatgtgg

SEQ ID NO: 304092 - DNA, 2537 bp, Homo sapiens
gtactgacagacattgtgtaattctctctaaatgaatactccatgctgagaccgaggatgctgttgcaacaagtcctcagcttagttcctctcagactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaaatgtgtccc

SEQ ID NO: 304093 - DNA, 2219 bp, Homo sapiens
acaaagaagcctgtacaaaaggccttgatgtatcttttcacccacccttgtgactgtgccataccctttctcccgctcttcctcggtgagaaggggtaagtggttattttgtgccctcgcccaatttggccgaaaccccgctgcgcagctcagccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaaatgtgtccc

SEQ ID NO: 304094 - DNA, 853 bp, Homo sapiens
cagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctggtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatgaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttaaaaaaaaaaaa

SEQ ID NO: 304095 - DNA, 236 bp, Homo sapiens
ctgccctccgtctcccttccggcgacgtgctcaggcacacaggagcagtcacagccttgctcaggccggttgctgggccctctacccaggagcttgcagccatggcagtgactctgccttcacagacatcaggctccacctcagaccccagaaatgtcccagcaaatgtggagggcattttctcacagggcttaagccttgttttttgctctccgggcatcctgccccaccaccag

SEQ ID NO: 304096 - DNA, 254 bp, Homo sapiens
cactcatcctcacggaggacctgaaagatggacctgctgtgggaatgggaatggggaagaagtggggccgtgtggacagccctgtcggggacagtgaggagactcagtgcctgtcctgggggacagctctgcctggaggctggggtctctttgaccttcctgagacatcctgatgcctccaccctacttctgtgtcccggcaggagtgagagcgcagagagccctgagacagcccctactggagcacctcctgg

SEQ ID NO: 304097 - DNA, 437 bp, Homo sapiens
agcggctttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304098 - DNA, 482 bp, Homo sapiens
  misc_feature (25)..(25): n is a, c, g, or t
  misc_feature (50)..(50): n is a, c, g, or t
ggcccgctcctagaacctagtgganccccccgggctgcaggaattcggcncgaggggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcgtcaagctcgtcataccgaagctcgtcataccgaagctcgtcataccgaagctcgtcataccg

SEQ ID NO: 304099 - DNA, 186 bp, Homo sapiens
  misc_feature (21)..(21): n is a, c, g, or t
cacttggggatgaaggctgcngctcggccattgaaaagccagcattgtcttggagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304100 - DNA, 942 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304101 - DNA, 1590 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggaaaaaaaaaaaaaaaaaaaaaaaaaagaaaaaaaaaaaaaaaacgcggggagctatttgtggggggggggaaaaaaagagggttaagaacaacgggagagaggcagcggaaaacaaagtaggagcgcaagcgcaacacgactatgtggtgacaagcagagggagaagacaaagccgacagccacccccaaacgggaggaggaagacaaaccaacatccccaagaacagacccagcgacaccgccttcatgcgaccggccccacacaccgaacaccgaagcacgcaggacgcagaaggccacagccgagaacggatgcagacccagagtacaacagcacaaggaggaagcgacaggaaggcaacgcagcagaacaaaaaagtcacacggaacacgagagaaaaagagtagaaaaacatcaaatcagacgaagagcgaagaagcagaaagcacagagcgagacaaagcgaaaagaaaggaagaagaaagaaggaggaagcaaagaaggaccacacagcagcgaccacaacacatgaatcgcgagacccaaagcatgaaacgcgacctgagaccaaacgagaaggagaaaaagcaagaccacaaaagacaacaacagcgcaccaagccgaagcaacagacggaaaacgtaa

SEQ ID NO: 304102 - DNA, 1313 bp, Homo sapiens
  misc_feature (1253)..(1253): n is a, c, g, or t
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggaaaaaaaaaaaaaaaaaaaaaaaaaaaaaaaaaaaggaaaaaaaaaaaaaaaataaaaaaaaaaaaaatatatataaaaaaataaataaataaaaaataaaaaataaaataatatataaattaaataattattaaataataaaataaataaaaaaaatttttgggtcctttagtgcaattctttttaaatctggagattttattgcttggccccctattttcggtcatcttgtgccaattttccctaaatgggggctgtttataaaacaaacggcccgggtttataaaaaaggtgtttgtgggcaccggtngggtccccaaattataagcgctttgtgaaacaaattccctttttcccgaagttggggtct

SEQ ID NO: 304103 - DNA, 1025 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcattaaatggaaaatccactaaaaaaaaa

SEQ ID NO: 304104 - DNA, 1142 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggaagaaaaaaaaaaaaaaaacgcggggagctatttgtggggggggggaaagggggtactggaatggggcacagggtcatacgctggtgttccgtggacccagttttctgggtacaacggggtcacgatctggcgcgggtctccctaataggggaggcggaattaattcggataagccaggttaacctggggtaatgaaccg

SEQ ID NO: 304105 - DNA, 428 bp, Homo sapiens
aattgccgtagaccgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304106 - DNA, 728 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304107 - DNA, 458 bp, Homo sapiens
  misc_feature (25)..(25): n is a, c, g, or t
  misc_feature (50)..(50): n is a, c, g, or t
ggcccgctcctagaacctagtgganccccccgggctgcaggaattcggcncgaggggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304108 - DNA, 1106 bp, Homo sapiens
agcggctttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggaaaaaaaaaaaaaaaaaaaaaaaaaaaaaaaaaaaaaaaaaaaaaaagaaaaaaaaaaaaaaaacgcggggagctatttgtggggggggggaaaaaaagagggttaagaacaacgggagagaggcagcggaaaacaaagtaggagcgcaagcgcaacacgactatgtggtgacaagcagagggagaagacaaagccgacagccacccccaaacgggaggaggaagacaaaccaacatccccaagaacagacccagcgacaccgccttcatgcgaccggccccacacaccgaacaccgaagcacgcaggacgcagaaggccacagccgagaacggatgcagacccagagtacaacagcacaaggaggaagcgacaggaaggcaacgcagcagaacaaaaaagtcacacggaacacgagagaaaaagagtagaaaaacatcaaatcagacgaagagcgaagaagcagaaagcacagagcgagacaaagcgaaaagaaaggaagaagaaagaaggaggaagcaaagaaggaccacacagcagcgaccacaacacatgaatcgcgagacccaaagcatgaaacgcgacctgagaccaaacgagaaggagaaaaagcaagaccacaaaagacaacaacagcgcaccaagccgaagcaacagacggaaaacgtaa

SEQ ID NO: 304109 - DNA, 1257 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctgtaagtggagtttttctgtttgcttagagatcagtgaatattgtgtccttggtcttatctgtgatgatcttatcccgaacctgaacttctgttgaaaaaaaaaaacttttacggatctggcttctgagatggaccgttataaggacaatatttttttttaatacttttaatgcttttacatatgttgtaatgtttgtagtcttgtaagaatctcgtgtttttccttttctagggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcattaaatggaaaatccactaaaaaaaaa

SEQ ID NO: 304110 - DNA, 1045 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaaggtaagagcttagttaagcttagtttccaaactaaaggagtaaacctgttgatttacaggaataggaactgttgcatcgtttgaaatttacttttttttgttagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304111 - DNA, 1244 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttaatgtattatgtgtacatatacaaggtctgattggtctaatcaatgatgaaacctatcccgaagctgataacctgaagaaaaataagtacggattcggcttctgagattaagaccagtaattcagaggtggagtaaattttgttgccgtgattttataacagttgtgttataaaatcctgggttttttttttttctgccaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304112 - DNA, 861 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304113 - DNA, 1559 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttaatgtattatgtgtacatatacaaggtctgattggtctaatcaatgatgaaacctatcccgaagctgataacctgaagaaaaataagtacggattcggcttctgagattaagaccagtaattcagaggtggagtaaattttgttgccgtgattttataacagttgtgttataaaatcctgggttttttttttttctgccaacagtgagggtcgctgtctgcccattgatagaggccagattgtcttggaagttccaaagttgcaacgatttctgtaagtggagtttttctgtttgcttagagatcagtgaatattgtgtccttggtcttatctgtgatgatcttatcccgaacctgaacttctgttgaaaaaaaaaaacttttacggatctggcttctgagatggaccgttataaggacaatatttttttttaatacttttaatgcttttacatatgttgtaatgtttgtagtcttgtaagaatctcgtgtttttccttttctagggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcattaaatggaaaatccactaaaaaaaaa

SEQ ID NO: 304114 - DNA, 1425 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaaggtaagagcttagttaagcttagtttccaaactaaaggagtaaacctgttgatttacaggaataggaactgttgcatcgtttgaaatttacttttttttgttagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttaatgtattatgtgtacatatacaaggtctgattggtctaatcaatgatgaaacctatcccgaagctgataacctgaagaaaaataagtacggattcggcttctgagattaagaccagtaattcagaggtggagtaaattttgttgccgtgattttataacagttgtgttataaaatcctgggttttttttttttctgccaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304115 - DNA, 1322 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttaatgtattatgtgtacatatacaaggtctgattggtctaatcaatgatgaaacctatcccgaagctgataacctgaagaaaaataagtacggattcggcttctgagattaagaccagtaattcagaggtggagtaaattttgttgccgtgattttataacagttgtgttataaaatcctgggttttttttttttctgccaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304116 - DNA, 1530 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggaaaaaaaaaaaaaaaaaaaaaaaaaaaaaaaaaaaaaaaaaaaaaaagaaaaaaaaaaaaaaaacgcggggagctatttgtggggggggggaaaaaaagagggttaagaacaacgggagagaggcagcggaaaacaaagtaggagcgcaagcgcaacacgactatgtggtgacaagcagagggagaagacaaagccgacagccacccccaaacgggaggaggaagacaaaccaacatccccaagaacagacccagcgacaccgccttcatgcgaccggccccacacaccgaacaccgaagcacgcaggacgcagaaggccacagccgagaacggatgcagacccagagtacaacagcacaaggaggaagcgacaggaaggcaacgcagcagaacaaaaaagtcacacggaacacgagagaaaaagagtagaaaaacatcaaatcagacgaagagcgaagaagcagaaagcacagagcgagacaaagcgaaaagaaaggaagaagaaagaaggaggaagcaaagaaggaccacacagcagcgaccacaacacatgaatcgcgagacccaaagcatgaaacgcgacctgagaccaaacgagaaggagaaaaagcaagaccacaaaagacaacaacagcgcaccaagccgaagcaacagacggaaaacgtaa

SEQ ID NO: 304117 - DNA, 782 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggttagttttaagagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttaagtggcacagtggagcagctctgaagatgcaaagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304118 - DNA, 743 bp, Homo sapiens
aattgccgtagaccgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctgtaagtggagtttttctgtttgcttagagatcagtgaatattgtgtccttggtcttatctgtgatgatcttatcccgaacctgaacttctgttgaaaaaaaaaaacttttacggatctggcttctgagatggaccgttataaggacaatatttttttttaatacttttaatgcttttacatatgttgtaatgtttgtagtcttgtaagaatctcgtgtttttccttttctagggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcattaaatggaaaatccactaaaaaaaaa

SEQ ID NO: 304119 - DNA, 356 bp, Homo sapiens
agcggctttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304120 - DNA, 568 bp, Homo sapiens
agcggctttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgaattttggcgtgaggaaccgctgatcggccacgggcgccgaacttgctggcctccggcatgtgcctgagcggcggcggaaaaaccaccttaattggggcggagggaacaatggcgctgtcttaagtggcacagtggagcagctctgaagatgcaaagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 304121 - DNA, 640 bp, Homo sapiens
agcggctttttacgtcggccttcgcgagcgtctgggcgggtggtaggaacaatggcgctgtcttaagtggcacagtggagcagctctgaagatgcaaagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggcaaaaaaaccaaaacaacaacagaaagataaaacacagccgtggttgggccgcatgggggccctgagaaaaaagtttgtagtaaacaactcgtggggggggccggcgggaccacagatgatggtataatgtgaaacacgtggtggcatataacagtggttcccataaaaggaggaacatcgcggggcgtcagagaacgaaggtgcgtgggactttctacacaccaaataaaaaaacgccgcggggggcaaaccggaggcgttttgggaaacaaactccgcaaaggggcagctcggaaggacaatgaggggatcactaccacaggaggtccaagggaccccagatataattgccgcgcgtgaga

SEQ ID NO: 304122 - DNA, 1367 bp, Homo sapiens
taagaaaaataaaagcatcagtattgcaaagactttccatgatcctacacccacctcgaaagccccctctcaccacaggaagtgcactgaccactggaggcataaaagaggtcctcaaagagcccgatcctcactctccttgcacagctcagcaggacctcagccatgagacttctcatcctggccctccttggcatctgctctctcactgcatacattgtggaaggtgtagggagtgaagtctcagataagaggacctgtgtgagcctcactacccagcgactgccggttagcagaatcaagacctacaccatcacggaaggctccttgagagcagtaatttttattaccaaacgtggcctaaaagtctgtgctgatccacaagccacatgggtgagagacgtggtcaggagcatggacaggaaatccaacaccagaaataacatgatccagaccaagccaacaggaacccagcaatcgaccaatacagctgtgactctgactggctagtagtctctggcaccctgtccgtctccagccagccagctcatttcactttacacgctcatggactgagtttatactcaccttttatgaaagcactgcatgaataaaattattcctttgtatttttacttttaaatgtcttctgtattcacttatatgttctaattaataaattatttattattaagaatagttccctagtctattcattatatttagggaaaggtagtgtatcattgttgtttgatttctgaccttgtacctctctttgatggtaaccataatggaagagattctggctagtgtctatcagaggtgaaagctatatcaatctctcttagagtccagcttgtaatggttctttacacatcagtcacaagttacagctgtgacaatggcaacaatttgagatgtatttcaacttgtctctataatagaattctgtttatagaataagggagaaaataatccagtcttcactgggttcccattctgagggtccactactcaaaaatttgcttcactcaatttttttcacctctttgtgttttattttggtgtcctattaaaggaataaaatgacacaacttgtcccttttttgtcccattagcaaaaattagaattttggtataaagaaactttattcaagtaaaaatcaataccctttgaattggacaataatctcactaccttattaggatttctgtatttgccattacgctagttatcatgcatgttatgctttactgcgaataagcttttaatgctccaaatgctgacccatgcaatatttcctcatgtgatcacaatttgcagtaaacttttaattaaatgctcatctggtaactcaacaccccag

SEQ ID NO: 304123 - DNA, 430 bp, Homo sapiens
ttccattctgctgctccctgctgagagcccatcagcggctccccattgcctaccaggaccagaatccacttggcagcactgaagaccctccctgaagactgagatataaaggcatcaaaaagagcttgagattttaagaaatgacagacctcagccttgcccttcacccaccagtggctcatacctaagcgctgcagactttacccgcacacctctagactctcttcctttctaaagatacggaaagaggataccaaacctctctggtaccagcccaactgtccctcctcacccctctgtccctgtcacacctgtccttttgtcaaactgcaggcagcctccagggccttggggcttcacccagggcacttgtctaccagccccacgaggtgcgtccagggctttcttgtcaccagttgggaaaagcagg

SEQ ID NO: 304124 - DNA, 290 bp, Homo sapiens
acctgggcatggctggaccactatggcaggagaaggaccctgtgtacaaacttcttggcttggctaccaggtcccaaagggcttttatagtgggcccccacctgcttgcttctgatagggactggcataagttccattttagaagtaacaaggcaagcccaagttcagtcagaatgagcaaaacaaatcagggacccacactactctaaataccctggggtggagggtgcacatctggagtaatttcaaggctttttccgtgtaatctgaggtggcaaccaagggggagg

SEQ ID NO: 304125 - DNA, 5225 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304126 - DNA, 5395 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccacccaaaaaaaaaggggcgcctaatacccggggccagttacatacctttgtcaaaggccaaaaggataagaacagcgataaagcgcggaacacatgattgagacacttggtaaagcaacaaaaacgataattgaactgttatgtataacaacgaaaggatagtttatgtaccata

SEQ ID NO: 304127 - DNA, 5419 bp, Homo sapiens
  misc_feature (5226)..(5226): n is a, c, g, or t
  misc_feature (5228)..(5228): n is a, c, g, or t
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccacccanangaaaaaaagaaaaaacaaaaagggggcgcgcaaaaatactccagggcccaagtaaccgcacccagtttttggaaagggccaaaggagccgaaaagaagcaggcgcgaaacgcgggaggcaactggcggaccggggaagacctcggggcaaggaacacaacaggaaagcaggaaaattgtagggacacagag

SEQ ID NO: 304128 - DNA, 5225 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgataacagaatattctgtaaacctaatgatgataactaatgaccgttatcgcagtcaccctata

SEQ ID NO: 304129 - DNA, 5101 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304130 - DNA, 5121 bp, Homo sapiens
tccggagcttatgtggttcttgcagagttcgagctgtatggaggcgccgagggagagaaggaaggtaatgtgactgggtgaatgaccgttgcactgaagggtccacagctccgttgtagtgccctgcattgctgctgcagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304131 - DNA, 4688 bp, Homo sapiens
ctgtgctagtatttgatgtaatcaatggccttcctcagtaccccagacttgtgcatcttggcgtctgtccccatgaccaggtctttcaattcgatgattttgtcattgatggaggagcgatatcgtttctcaatgatattatgggttgtccgcctttctccttctttggggggctcaagctgcttgatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304132 - DNA, 4894 bp, Homo sapiens
  misc_feature (94)..(94): n is a, c, g, or t
tcccaagttagtcgggacgatgaggggatatgaaggagaagcaggcatcagaggagatgaggaggaagtaggcattgtcaccaatgactcctanatcaggaatctgaacgcagaaggccagcgatttgatggagggagtcacacccaaagcctcagtgcaaattctcttagcagtgccccctgctgtgccttggcaatcgtaaataaatcagatgtgaacgcaccacacaccctcacatatctgagttgcttactttggccaccccagccttcaactagttcccttaacccatcctctgcagagcccactccctctcatataaacacagaatgcacctaaatcaacttcatgtctcctgggtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304133 - DNA, 5325 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagtttacggaaaaaaatctggggcaactcacagcattgaggaagagttaaacatccacatttcaagaggaacaagaaccagaacactcctcagcagcaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304134 - DNA, 5316 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacagtaagtgtgctgagaaaaggcttgtcagccctggcccaggtggggctttgtaaaagcagatcattttcaccaggtggggttttctttgcagagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304135 - DNA, 5200 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304136 - DNA, 3809 bp, Homo sapiens
atttcaatgaaggggatggggcttaattgttacattagatggtccggtcgtcccgtacaccttaggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304137 - DNA, 3817 bp, Homo sapiens
taatttcagtgctcgggccggggtgtaagttctacattaactggtccgtgcgtcctctgacattaaaaatggggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304138 - DNA, 5171 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaagatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304139 - DNA, 3990 bp, Homo sapiens
acctgggcatggctggaccactatggcaggagaaggaccctgtgtacaaacttcttggcttggctaccaggtcccaaagggcttttatagtgggcccccacctgcttgcttctgatagggactggcataagttccattttagaagtaacaaggcaagcccaagttcagtcagaatgagcaaaacaaatcagggacccacactactctaaataccctggggtggaggggtggtacctatttgaaggaggatatcgtgttttttatctgaggttgcaaaaccaatgcctcaaccctttcaaaacaaagatttttatggcactcagctccataatgagaagggctacagtcattagccctgtttagattatagaattatttgccctttcttctgaaaatgaggtagaagactctttcctgtgatagtgctggggtctgtcaggtgcctggctgctccgcaaggcctttcctagcagactctgctgagacgctccttcttaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304140 - DNA, 3560 bp, Homo sapiens
aaaaagtgctactctgagggaactctgaccagcatttgctcatagaacaaacgcacgcagtacaatctcaatcgagtaaaaagtctgtaaggaaatacctcagaatgtcagcagggattcttcctgggggatgagattataggtggttttgttttactttcttgtagctttctgaagtttccctcgtttttatgagtgtgcactaattcctctgataattgggggcagggggagtagaagtctatatcaaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304141 - DNA, 5594 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagaccacctccacccccaccatcaaccctggcaactttgtcctgtaactaaaatagcctttagcacatggcataaccggagagcttttgacattcctctttggagattcatgtctgcgtcttgggggcattcggcactagtgatgggcagccctgcctgctgactccccggctgtttctaattggatctgagtattctaagagaaactgtaaaatgctccaagacagaaaggccccacgaggtcctatccttagagccaaggctgtagcatttcctatcaagcagacccttaaccggcgcacaggaaggagctgagaagacagcagacgtgatggtgaagcctgtgtctctgacttccagcattgaatgaaggagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304142 - DNA, 5197 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304143 - DNA, 5167 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccagtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304144 - DNA, 2471 bp, Homo sapiens
cacagatattatcagtcggtcccgttgtatttcatcacgaggatcgtgttggcatttctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304145 - DNA, 4469 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304146 - DNA, 4233 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304147 - DNA, 2362 bp, Homo sapiens
cgcttcctctagcatgactgctacacgctccctggtgaaacaattctttaggcttcataagtcatgctgtgcatgctgtcacgtgtgcgagctcagtagtcgtaagtacgttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304148 - DNA, 2673 bp, Homo sapiens
  misc_feature (366)..(366): n is a, c, g, or t
atgtactcgttgttcggctgttgttactaccaacttgttgtgttgctttcgtggctgtgtctactattgcgttatcttctttttgtgtctgactgaagcttgctccccctctaagtacctctgtggttggctctcctctggcttcttctctctctcggtggggttcctccccgtggtttttctctctgcgactaagtgctccctgagcccctctttccgtactgttgcccgtgtgcacaaaaaacacctgtggcccaaacgtcaccgaaacatctgccccttgcgaaccagctcatcaaacttcatcctgaatctcctcgccactgcagccacgtttgtagaccagggaagagagacttgattcangcgctcataaatcacacggaggtgtgtcataacctgggaccggatctgacggctttcttgggatccaaccatgcgcacatgctcgaaatgctttagggtgtgctgtctgtccttctgttctgcgcggacatacttctttagctgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304149 - DNA, 1936 bp, Homo sapiens
ttccattctgctgctccctgctgagagcccatcagcggctccccattgcctaccaggaccagaatccacttggcagcactgaagaccctccctgaagactgagatataaaggcatcaaaaagagcttgagattttaagaaatgacagacctcagccttgcccttcacccaccagtggctcatacctaagcgctgcagactttacccgcacacctctagactctcttcctttctaaagatacggaaagaggataccaaacctctctggtaccagcccaactgtccctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304150 - DNA, 3125 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggcagctgccaacaagaagcattagaacaaaccatgctgggttaataaattgcctcattcgt

SEQ ID NO: 304151 - DNA, 3210 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagtgcgtaaccctccttggccactcacttgcttctctccaggggaatcttgtttgagttagcaggagcaaactggactgggtgggcgtgttggggtgaagggtcaggactgcatgacaggtgggcggctagaaaagtcgggggtgagggcaccatggagaactcaagttgggccagcaggtcctctgtgcaagtgtcctgctctgcacaacacgacagttgtcccagcagctgtcagcactgtgtccgggtcctcctccctgcagccttcatggcgccacaggctgaaaagaagagacgagagcagtgtggcccccagc

SEQ ID NO: 304152 - DNA, 3467 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagaccacctccacccccaccatcaaccctggcaactttgtcctgtaactaaaatagcctttagcacatggcataaccggagagcttttgacattcctctttggagattcatgtctgcgtcttgggggcattcggcactagtgatgggcagccctgcctgctgactccccggctgtttctaattggatctgagtattctaagagaaactgtaaaatgctccaagacagaaaggccccacgaggtcctatccttagagccaaggctgtagcatttcctatcaagcagacccttaaccggcgcacaggaaggagctgagaagagtgagtatacacaggcttgaagtcctttgttccctgaagtagatgtgacaccctaatttcattgaagtagccccatttgtaagcactctgactaggtaagcacccagcccggtatagcattccacctgtatgtgtgtctcccccagtcgatgtgcctgaggacactgagactcagcaggtaagttgtccaaagtcacctcgctccagagcagcagagcttccatggacagccaagacacccctgcaggcactgctgcc

SEQ ID NO: 304153 - DNA, 2881 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccgtgagtacccttcggttcccttctgtaaacctcccctgagcacttacctagccaggagttaagatgcagaagcagttatgaacccccttccccatcaggtgctgcccacctggaggggtaggcaggcattcattcagtcgctcatttcaccaggactcccagcaaccgataaaacagaccaaaattcctccccttgtggccttaataccataagccttgtaggcaggacattttggtcccctgaggtaatatgaggtaatatgaagattggttcagcaatagcagagctactgtacttgggggttaatatgcaacttttctgttcttcaagtggtcataaaaattcttagaatcccctggttatgtctcatggttctttcatttactcagaaggtatttattgggcatcttgtgttgatcacagcactgtgaatccagaaataaaagccagtgcctttgccaagctacagagttaaagaaaagaaaaatgaaatgaataaaagtaaaagaaaacctgtg

SEQ ID NO: 304154 - DNA, 1754 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggtaggtggaggccccttgccc

SEQ ID NO: 304155 - DNA, 1483 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccaccca

SEQ ID NO: 304156 - DNA, 1809 bp, Homo sapiens
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaaggtgggtgccaagcaaaattgtgttttatgttccaccatctcccctctacctgtttttgcctcaggagcctagagaagtcccaggctcaaggtaagtgaatacaagaccgagttagaggtgcttttttattaaagcatcttggtgtcatgtcaagattataaaatattaaaaaacataagggactggtgagggttgataaggcagtgacccgctgagacctttgactcctttggctatgctctgcagtgatggggactccactgtcagaggcagagaaagatgcctgccactcagtagttccagatacaggactgtgtgtaccttggagtcagctgatggcatagttttagctgtgtttaggggttaccttttaaggaaaagaaagaaaaaagaggttgagtctttgaccagcaacacatagaggaaactgatgttccaaatgtttctggtgtttcagtgtatgtgtcttctagaaagtaggagattttatttttaaaacctatctatgtttaaaccctattttgaaagaaaatttcattttcctgcctaccatcgtcggtagctgt

SEQ ID NO: 304157 - DNA, 1789 bp, Homo sapiens
  misc_feature (1747)..(1747): n is a, c, g, or t
  misc_feature (1753)..(1753): n is a, c, g, or t
  misc_feature (1767)..(1767): n is a, c, g, or t
  misc_feature (1769)..(1769): n is a, c, g, or t
cgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaaggtgggtgccaagcaaaattgtgttttatgttccaccatctcccctctacctgtttttgcctcaggagcctagagaagtcccaggctcaaggtaagtgaatacaagaccgagttagaggtgcttttttattaaagcatcttggtgtcatgtcaagattataaaatattaaaaaacataagggactggtgagggttgataaggcagtgacccgctgagacctttgactcctttggctatgctctgcagtgatggggactccactgtcagaggcagagaaagatgcctgccactcagtagttccagatacaggactgtgtgtaccttggagtcagctgatggcatagttttagctgtgtttaggggttaccttttaaggaaaagaaagaaaaaagaggttgagtctttgaccagcaacacatagaggaaactgatgttccaaatgtttctggtgtttcagtgtatgtgtctttcaaaatagggtttaaacatagataggttttaaanataaantctccgtcgagcgncngcgaatgtagtagtagtagc

SEQ ID NO: 304158 - DNA, 562 bp, Homo sapiens
cacctaaggtcaggagttcgagacccacctatcaatatggtgaaaccctgtctctactaaaattacaaaaattagccgggcatggtgccgtgcacctatagtcccagctactcaggaggctgaggcgggagaatcgcttgaacccaggaggcagaggttgaagtaagacaagttcgcgccactgcactccatccagcgtgggcgatagaggaagactccgtctcaaaaagaaaaaagaaagaaaatgagagaaagggcctggaggtgagtgtgaggagggaaaagaacatcaaacagataaagtcctgtcctgttgtcctgggaccttgggcagccatcttggcccagatgatccccacaagaaagaggtaagggtttcctgacccatttctgccatggtcttaggaaagtcattgagttttcatgccttagtttcttaagcaagtttgaaagttcactttttggatagcaataaaattactccttttcttttgttcacagagatgctgcaatttgtcagtaatcaagtgggagagttccctgacttgttttcagaacagct

SEQ ID NO: 304159 - DNA, 473 bp, Homo sapiens
taacaaagggatcattctgctgtgtacctgtccctattctagaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaaggtgggtgccaagcaaaattgtgttttatgttccaccatctcccctctacctgtttttgcctcaggagcctagagaagtcccaggctcaaggtaagtgaatacaagaccgagttagaggtgcttttttattaaagcatcttggtgtcatgtcaagattataaaatattaaaaaacataagggactggtgagggttgataaggcagtgacc

SEQ ID NO: 304160 - DNA, 1160 bp, Homo sapiens
gtatttttagtagagacggggtttctccatgttggccaagctggtctcaaactcctgacctcaggtgacccacctgcctcagcctcccaaagtgctggaattaagaggtgtgagccaccacacctggcctacagcagatttatttcagtagctgaaatagttaaaacataatgattccaaaggctgagaagcatgcagaaaaaattgaatctttattgctgatgggaatataaaactgtataccacattggaaaataatttggcaatttcttttaaagctaaacacacacatacagttagttaggcttagcaattgctgtcatggcctatttcatagaaatgaaaatttatgtgtagaccaaacctgcacttgactgttcacagaaattttatttgtaatagtcagaacctggaaacaactcacatgttattcaccaggtaaacagttaaataagtctgttatttccgtattgtgtaatacaactcaaaaattaaaaggaataaactactactatacaaataagccttagatgattctcaattctgaaggaaaaacccatttcaagttgtaacataatgcttatttttatgtatcttaatgtgatgaagttaaatagtttagagaacattgttcgtattcatctgttagggatggtagaagttagggttgtatgtgattataagactagtggaagggatacgtttttaatgatggatgagttctgcattctgattcatgcagtggttacaaaaatgtatacatgtgataaaatgtcatgtaaatgtgcacatttcaccaatgacaatgtgctggttgtgatattgtacaatgttaatggaaaatatcaccactggggaaaattgagtggtatgtgtaaacggtactatatttgcagcattttgtgagtctttattttaacataatatgtaaatatgtaaagcaactagaagaatggttttaatacaggagagtaacagcttataagcaagagaaagaaaaatgataaataatgtgaacacttaccaaaggaagggtggaacagagaaataaaggacagggaaaattatctgggatgattcctaaattccaatatttggatggaactatacagaattttaatatatctggaaaataaactgaaaatattaacggatccaca

SEQ ID NO: 304161 - DNA, 692 bp, Homo sapiens
aaaaacacaagatttccttatgcgttttttgtgacctcctctgaatctataattaaattaaaagatttttttaagaagtctctattatacctgaagcccaagaagtaagctgagttaagaatgtttttcaagttccttgggtatttttcaacatagatgaaggtgctctaaatcttattgtcttccttctatttattctgagttgcttatagaatagaatgtgtttttaaaacccctgaaaaaggttggcaatctagtgtgtccgtagagagaataatacaatcttggcacataggggatgcctaaagcttatatattctttgatttgagtttataaggacagttacttttttccaagcaatatttaaaactgaatcttccctgagtcaccttaacttttaaatggaggtcaggctccctggttggaaatagcatgttttataattgtgtactgttaagttctacaaggtaaaactctaccacattggaacaggaatgaccaaaagaagacaaaagtaaagaagaaaacaagcaatccgcagtttaatgaaatcttttattttgagttttgttttacgtaaatgttaacattaaatatgtaatatttaatgctagttgatttcttttttcaaaccacagtcatagtaatcattttatcaattaatgcagataagcctttctctcctgaaagc

SEQ ID NO: 304162 - DNA, 650 bp, Homo sapiens
aaaaacacaagatttccttatgcgttttttgtgacctcctctgaatctataattaaattaaaagatttttttaagaagtctctattatacctgaagcccaagaagtaagctgagttaagaatgtttttcaagttccttgggtatttttcaacatagatgaaggtgctctaaatcttattgtcttccttctatttattctgagttgcttatagaatagaatgtgtttttaaaacccctgaaaaaggttggcaatctagtgtgtccgtagagagaataatacaatcttggcacataggggatgcctaaagcttatatattctttgatttgagtttataaggacagttacttttttccaagcaatatttaaaactgaatcttccctgagtcaccttaacttttaaatggaggtcaggctccctggttggaaatagcatgttttataattgtgtactgttaagttctacaaggtaaaactctaccacattggaacaggaatgaccaaaagaagacaaaagtaaagaagttttgttttacgtaaatgttaacattaaatatgtaatatttaatgctagttgatttcttttttcaaaccacagtcatagtaatcattttatcaattaatgcagataagcctttctctcctgaaagc

SEQ ID NO: 304163 - DNA, 5577 bp, Homo sapiens
atggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaaaaggatgatatggggaaatttgccataaatgccggttctggttcttagtttagccatttccatcagttgaaattgtggtgtgatctgttgcttgtttcgttgttgttttgtttttgtgtagctttgttttttaatattcatttaataagatgatgggcaatagcaaacatttttactcccaggaatataatttatcaaattgaactattttatttgccaaagaaacttgtttttaatatcacgggtaatgggtaagtgtgaaaactaggcttttttttatgaaacaaaaaaaggtgacgaataatatggcttttgtttctgtttctgaagcctgatttcatttatgccaggttttgaaaaacagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcttccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagc

SEQ ID NO: 304164 - DNA, 5611 bp, Homo sapiens
atggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaaaaggatgatatggggaaatttgccataaatgccggttctggttcttagtttagccatttccatcagttgaaattgtggtgtgatctgttgcttgtttcgttgttgttttgtttttgtgtagctttgttttttaatattcatttaataagatgatgggcaatagcaaacatttttactcccaggaatataatttatcaaattgaactattttatttgccaaagaaacttgtttttaatatcacgggtaatgggtaagtgtgaaaactaggcttttttttatgaaacaaaaaaaggtgacgaataatatggcttttgtttctgtttctgaagcctgatttcatttatgccaggttttgaaaaacagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcttccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagcctgtctgttctttgtgagactgtattttcttact

SEQ ID NO: 304165 - DNA, 5265 bp, Homo sapiens
atggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctactttccctttgaaatttcaggggtcactatctaaactaaatccggggagaaggtgttgggcatccaagcggcggttaacacccgaaggggacggggacgagaggggagcgtatatctgcgggcctctcttctttatttctgagtcgatatttatttcttcgaacaaaccaacacagaatagaaaaacacatacaaagataaacacataaaacgagaaagagagagggaaaaagcgaagagacaaagagagagagagagagggggaaacgagacaggggaacgcggagacagagcgagcgaggactggagcacgagcagggggggcgcgcgaaagagaataagcaggagtatagaaggacgagaggggagagcggaggggcgaagtagggagagagagaagcgagaaacgagaaaaggaagacatgacaacgacacgaaggaggcagaagccaaggagagaacgagagaaagccggcgacaaacagaggggaccagagagaagacaagaaa

SEQ ID NO: 304166 - DNA, 4888 bp, Homo sapiens
atggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaagatcaccttggtgttccttgtttggaagattacttcctctgaatttctgggcttttg

SEQ ID NO: 304167 - DNA, 4658 bp, Homo sapiens
gccttgttctaactactttatgtgttaacttatttggtcctcctagcaacctggtaaggtaaattctgttatcatccacatgtgcagataaggaaatcacaatacagtaacttttccaagctcacacaactgacaaattatgatttgatcatactcgatttgaattggatttaactgggattcaaattcagtcagtctttatcatctgtgagcttaatcctatcccttccaacctcttagacagatgttcaagtacctataatgtatcattccatgctcagtactggagatgcagtgatgagtaagatactctttgcccttaggaaactcacagccaagaggagttgctcaatagtgtagggaaaacagatgagttttagagttaaaccaggttctgaatacccatttcttctctcaacggctacatgacattgacactcacttaactttgtgagaactgaatagaaccatgttgcagtggcagcaccacgccctttcttgccaaaggataaatggtctgtgagtagccccagcagagagtgggccagtgtccttttgttcacagggctgtccattctgtggctttgttactaaagctgcacagaactctgaggcagtgaaagcgtggtagcaacattctggacataaacagaacacctacttctgaacttgatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaaaaggatgatatggggaaatttgccataaatgccggttctggttcttagtttagccatttccatcagttgaaattgtggtgtgatctgttgcttgtttcgttgttgttttgtttttgtgtagctttgttttttaatattcatttaataagatgatgggcaatagcaaacatttttactcccaggaatataatttatcaaattgaactattttatttgccaaagaaacttgtttttaatatcacgggtaatgggtaagtgtgaaaactaggcttttttttatgaaacaaaaaaaggtgacgaataatatggcttttgtttctgtttctgaagcctgatttcatttatgccaggttttgaaaaacagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcttccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagc

SEQ ID NO: 304168 - DNA, 4669 bp, Homo sapiens
aggagaggttgcagtgagctgagattgcaccactgcactccagcctgggcaacagagtgagcctctgtctccacataaataaataaataaataaataatacttttataatacttgtcatttgtaaattagggatttcctctctaattaaatatgtgttttgttttataaattactattatgtgtattcattaataatgaagaacttcccattataattaatgacatgtaagataaactgaattttttataatgtaccttatcacacagtgtaatatttgcccatttccccatttagttcttggatgaaatttcatctactgaaactaaagagtccagtggtacgagtgagcctgtgcacctgaaagaagggtaatttaatcaaattagacgtgaaagtcatatatcagtatagatattaagtaagtacaaagagcgtgggtctaagagtgaggagatctggctttgtgtgctgtgttagaactgccaaaattagcagtcaggtaagtcgcctttactgtcctacaaactttatggcaaaaaaagcatgatttcctgtgcatacagtcctagagttgttttgcaattatagtgagatgatgggtatttagagtacttttaaaaagtaacagcactattagtcttaatgtaaagtgtttattataagttaagggggggaaccactcatttgacccttttttgttctgtatagtacaattaaaaatattaaattaattaaagaccttattcctttagtgtggccaaaataaatgcaacagtcatggatagcaaaaacatttttatatatttaatataatcttacactactattcatgtcatttaaagttaaaggatacttctttgttttggattaacttttaatttttatagctaaatgtttacatctgttatgttggcagtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaaaaggatgatatggggaaatttgccataaatgccggttctggttcttagtttagccatttccatcagttgaaattgtggtgtgatctgttgcttgtttcgttgttgttttgtttttgtgtagctttgttttttaatattcatttaataagatgatgggcaatagcaaacatttttactcccaggaatataatttatcaaattgaactattttatttgccaaagaaacttgtttttaatatcacgggtaatgggtaagtgtgaaaactaggcttttttttatgaaacaaaaaaaggtgacgaataatatggcttttgtttctgtttctgaagcctgatttcatttatgccaggttttgaaaaacagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcttccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagc

SEQ ID NO: 304169 - DNA, 6007 bp, Homo sapiens
aaaaacacaagatttccttatgcgttttttgtgacctcctctgaatctataattaaattaaaagatttttttaagaagtctctattatacctgaagcccaagaagtaagctgagttaagaatgtttttcaagttccttgggtatttttcaacatagatgaaggtgctctaaatcttattgtcttccttctatttattctgagttgcttatagaatagaatgtgtttttaaaacccctgaaaaaggttggcaatctagtgtgtccgtagagagaataatacaatcttggcacataggggatgcctaaagcttatatattctttgatttgagtttataaggacagttacttttttccaagcaatatttaaaactgaatcttccctgagtcaccttaacttttaaatggaggtcaggctccctggttggaaatagcatgttttataattgtgtactgttaagttctacaaggtaaaactctaccacattggaacaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaagggtaatttaatcaaattagacgtgaaagtcatatatcagtatagatattaagtaagtacaaagagcgtgggtctaagagtgaggagatctggctttgtgtgctgtgttagaactgccaaaattagcagtcaggtaagtcgcctttactgtcctacaaactttatggcaaaaaaagcatgatttcctgtgcatacagtcctagagttgttttgcaattatagtgagatgatgggtatttagagtacttttaaaaagtaacagcactattagtcttaatgtaaagtgtttattataagttaagggggggaaccactcatttgacccttttttgttctgtatagtacaattaaaaatattaaattaattaaagaccttattcctttagtgtggccaaaataaatgcaacagtcatggatagcaaaaacatttttatatatttaatataatcttacactactattcatgtcatttaaagttaaaggatacttctttgttttggattaacttttaatttttatagctaaatgtttacatctgttatgttggcagtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaaaaggatgatatggggaaatttgccataaatgccggttctggttcttagtttagccatttccatcagttgaaattgtggtgtgatctgttgcttgtttcgttgttgttttgtttttgtgtagctttgttttttaatattcatttaataagatgatgggcaatagcaaacatttttactcccaggaatataatttatcaaattgaactattttatttgccaaagaaacttgtttttaatatcacgggtaatgggtaagtgtgaaaactaggcttttttttatgaaacaaaaaaaggtgacgaataatatggcttttgtttctgtttctgaagcctgatttcatttatgccaggttttgaaaaacagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcttccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagc

SEQ ID NO: 304170 - DNA, 5941 bp, Homo sapiens
gccttgttctaactactttatgtgttaacttatttggtcctcctagcaacctggtaaggtaaattctgttatcatccacatgtgcagataaggaaatcacaatacagtaacttttccaagctcacacaactgacaaattatgatttgatcatactcgatttgaattggatttaactgggattcaaattcagtcagtctttatcatctgtgagcttaatcctatcccttccaacctcttagacagatgttcaagtacctataatgtatcattccatgctcagtactggagatgcagtgatgagtaagatactctttgcccttaggaaactcacagccaagaggagttgctcaatagtgtagggaaaacagatgagttttagagttaaaccaggttctgaatacccatttcttctctcaacggctacatgacattgacactcacttaactttgtgagaactgaatagaaccatgttgcagtggcagcaccacgccctttcttgccaaaggataaatggtctgtgagtagccccagcagagagtgggccagtgtccttttgttcacagggctgtccattctgtggctttgttactaaagctgcacagaactctgaggcagtgaaagcgtggtagcaacattctggacataaacagaacacctacttctgaacttgtgagtctgccttgtattcatacttgaatttgcatattcctgtaacagatgttggtggatacttaggttggttctatgactttgctattgtaaatagtgctgcaggaaacatgagtgcaggtgccaggacatctttaagaatattattttcttcaaagacagagaattgtagggaccttttatagatgtaatgaaatcccagatgttacagctaaaatgttttctgaatagacttaatttaggtgtgtatctactttataagtatattataaggatcatatttcggatattccttcctttccagattaccttatattctggtcatctcttccccttcacattcattgcctgttttcaatgtgggggttggggggatactaaaatatcaaggaatgggagccaaaaatcaaactaaagcttttctgtatctaaatttttctggatatgtttttagatgcaagatactgtttacttgaatccgtaaataaaaatggtctgtgttttgatagaaacttacacaaatgtatggattggtgaaaattcagcagggtattcatttaatacctattcattttgtcatatgtaaattatatctcaatttttaaaaaaatgaaggagcaaagattcctgagggaacaccgtttagtcaattttatatgctactatatattacttctttcagatagacaggcctgaaaaacctcttggataatagacccaaataatcaccctctggatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaagggtaatttaatcaaattagacgtgaaagtcatatatcagtatagatattaagtaagtacaaagagcgtgggtctaagagtgaggagatctggctttgtgtgctgtgttagaactgccaaaattagcagtcaggtaagtcgcctttactgtcctacaaactttatggcaaaaaaagcatgatttcctgtgcatacagtcctagagttgttttgcaattatagtgagatgatgggtatttagagtacttttaaaaagtaacagcactattagtcttaatgtaaagtgtttattataagttaagggggggaaccactcatttgacccttttttgttctgtatagtacaattaaaaatattaaattaattaaagaccttattcctttagtgtggccaaaataaatgcaacagtcatggatagcaaaaacatttttatatatttaatataatcttacactactattcatgtcatttaaagttaaaggatacttctttgttttggattaacttttaatttttatagctaaatgtttacatctgttatgttggcagtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaaaaggatgatatggggaaatttgccataaatgccggttctggttcttagtttagccatttccatcagttgaaattgtggtgtgatctgttgcttgtttcgttgttgttttgtttttgtgtagctttgttttttaatattcatttaataagatgatgggcaatagcaaacatttttactcccaggaatataatttatcaaattgaactattttatttgccaaagaaacttgtttttaatatcacgggtaatgggtaagtgtgaaaactaggcttttttttatgaaacaaaaaaaggtgacgaataatatggcttttgtttctgtttctgaagcctgatttcatttatgccaggttttgaaaaacagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcttccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagc

SEQ ID NO: 304171 - DNA, 3807 bp, Homo sapiens
aaaaaaaaaaaaaaaaaaaaaaaaagtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaaaaggatgatatggggaaatttgccataaatgccggttctggttcttagtttagccatttccatcagttgaaattgtggtgtgatctgttgcttgtttcgttgttgttttgtttttgtgtagctttgttttttaatattcatttaataagatgatgggcaatagcaaacatttttactcccaggaatataatttatcaaattgaactattttatttgccaaagaaacttgtttttaatatcacgggtaatgggtaagtgtgaaaactaggcttttttttatgaaacaaaaaaaggtgacgaataatatggcttttgtttctgtttctgaagcctgatttcatttatgccaggttttgaaaaacagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcttccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagc

SEQ ID NO: 304172 - DNA, 1213 bp, Homo sapiens
atggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttaataaggaggtaccgagctcgattt

SEQ ID NO: 304173 - DNA, 1917 bp, Homo sapiens
atggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtatgagctcatggaagaactcggattggaacagccagtagttgtgttatgcctatagtggggtttttctgttctcagggttctt

SEQ ID NO: 304174 - DNA, 733 bp, Homo sapiens
gctttagcatgaggatatgatgccatagagctggcttggtttgtagcttctcatttagggtttgcaccactttcttttcctttttagaggccacagcagttttgatgtattatcaaaccgcaaaatgtaccttgttgggtatttagcagaaggaaatgtgttgactgttacacatcccttatctacagtgcttgagactgttttgaatttcttattcttattttttttttgagtatttgcattatatatacttgcccattaagcatcccaaatccaaaaagcccaaatttgaaatgctgcagtgagcatttccttggagcatcatgtcagtgctcagaaagttttgaattttggaggactttggatttttgaatttggaatgctcagtctgtgtttgatagtttcattagtgattgtggcattcctgtttagtctcattttgaaaatacagcataaatttaaaaatgcatacatacatatgtccatacatattactacctattccatataggtagtatatagccatacaactgcagacacatggaaaacaattcttaaccttttgaatgtattagtttgtgtttaaagataatgttttatcttgtttaactggaatctaatatgttaaatctcttttattctaccttagcatcaaggcatgccatgggttgcctctcataaatggccaaagctgtgacccttatgcaacagtttctctagtgggcccttctag

SEQ ID NO: 304175 - DNA, 246 bp, Homo sapiens
gcggccgcgactactactactactaaattcgcggccgcgtcgactaaagtatcccactaaattcaaaagcgagaaaggaaaagattcattaatttgaatacatacaaaattaaaaatatttttctgtgacatcaaacagtactgtcaaaagaaaaagaacaaataatgaaataattgaaatatatacaataggcaaatataatttcccgaatacgtgaagaactcctataaatccctaagaaaaaa

SEQ ID NO: 304176 - DNA, 552 bp, Homo sapiens
  misc_feature (415)..(415): n is a, c, g, or t
  misc_feature (419)..(419): n is a, c, g, or t
  misc_feature (444)..(444): n is a, c, g, or t
  misc_feature (461)..(461): n is a, c, g, or t
  misc_feature (520)..(520): n is a, c, g, or t
  misc_feature (541)..(541): n is a, c, g, or t
  misc_feature (549)..(549): n is a, c, g, or t
attaatcccatgaaaagcctgtagaaactgctacgacataactaattgattttgcattagggtgatcattcagttgacataaatctttctcacagtaaatttatataatatcgtaatgcccaagccttccattgtgtttgactacctcccctccctaaccttagtctggatgcagggtctttaaggtgtatgataaatgagctgtttactaatttcctgttgaagtgaatacacatttgcaattattggaatttattatttgggggcatctggctcatccttgtttttgtttgttaaacaggaaaaggaccagcgcagcctagacataaacactgccaagtgcatgttgggactgttattaggaaaaatctggcccctttttccagtttttcaccaattcttagaggagcaatcnaaantacaaaggtatttaataaaggaccngttggggcaatgttccnaggagttttggcaggaccatttaattcttggaccccagcaactttggtggaaggatggngcctgggcccttttttttggncgagtttnttg

SEQ ID NO: 304177 - DNA, 4313 bp, Homo sapiens
tgagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcaga

SEQ ID NO: 304178 - DNA, 4244 bp, Homo sapiens
  misc_feature (8)..(8): n is a, c, g, or t
  misc_feature (10)..(10): n is a, c, g, or t
  misc_feature (12)..(12): n is a, c, g, or t
ccaaattngncnttggccggggagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcaga

SEQ ID NO: 304179 - DNA, 4032 bp, Homo sapiens
tgagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgtt

SEQ ID NO: 304180 - DNA, 4400 bp, Homo sapiens
tgagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggccgaagatggtgttagtgattgcgagctgctggctggcacccttgcagagcaggagtaagtgagtgctgttcagctttccagtcctgaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcaga

SEQ ID NO: 304181 - DNA, 4369 bp, Homo sapiens
tgagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggccgaagatggtgttagtgattgcgagctgctggctggcacccttgcagagcaggagaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcaga

SEQ ID NO: 304182 - DNA, 4937 bp, Homo sapiens
  misc_feature (8)..(8): n is a, c, g, or t
  misc_feature (10)..(10): n is a, c, g, or t
  misc_feature (12)..(12): n is a, c, g, or t
ccaaattngncnttggccggggagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtgagtcaaacttactgagttgggtgaatcagttggttgtttttcatacttaaatctttgttctttagcaaataaataaataattaaaaagtagtggtatgttagtttttatgaagcagtctaagaaataagttctaattctagtttgacttataagcagattctccattcttgtaagtgatatggtgtaactacagttattttttctctcatttaatttcttgtatgtaaaaggtacagtaagccagatgcttacaaaatggtgtggccacatgtgcctacaatgacggatcaactggaggccacattgtacgctgtgtaccttcgtgcccctcagtagttgttttagcctaatgtagagtcaatctaggacttataattattcatcatgattttgagtagattgtaatcatcaagaatttttcatagatcgtttacttccaattgaatttagctcagaagtgattgcttttttttttttgagatggagtctcgcactgtcgccaggctggagtgcaatggtatgatgtcggctcactgcaacctctgcctcccgggttgaagcgatttcccctgcctcagcctcctgagtagctgggactacaggtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggccgaagatggtgttagtgattgcgagctgctggctggcacccttgcagagcaggagtaagtgagtgctgttcagctttccagtcctgaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcaga

SEQ ID NO: 304183 - DNA, 4525 bp, Homo sapiens
ggctggacgtgcgatgaagggccgagatcggagtgtccggggtgcatggaggtggaggcagcgttgggctgtagcgggcagggccggggatgtgggggggtggcaccggcggggagagggagggagcgagcgagcgagcggggcacaagggtgaggatttccaaagggctgagtggtgcgggcggctccgtgagaaaggcggattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacttttgagatggagtctcgcactgtcgccaggctggagtgcaatggtatgatgtcggctcactgcaacctctgcctcccgggttgaagcgatttcccctgcctcagcctcctgagtagctgggactacaggtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggccgaagatggtgttagtgattgcgagctgctggctggcacccttgcagagcaggagtaagtgagtgctgttcagctttccagtcctgaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcaga

SEQ ID NO: 304184 - DNA, 4897 bp, Homo sapiens
  misc_feature (8)..(8): n is a, c, g, or t
  misc_feature (10)..(10): n is a, c, g, or t
  misc_feature (12)..(12): n is a, c, g, or t
ccaaattngncnttggccggggagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtgagtcaaacttactgagttgggtgaatcagttggttgtttttcatacttaaatctttgttctttagcaaataaataaataattaaaaagtagtggtatgttagtttttatgaagcagtctaagaaataagttctaattctagtttgacttataagcagattctccattcttgtaagtgatatggtgtaactacagttattttttctctcatttaatttcttgtatgtaaaaggtacagtaagccagatgcttacaaaatggtgtggccacatgtgcctacaatgacggatcaactggaggccacattgtacgctgtgtaccttcgtgcccctcagtagttgttttagcctaatgtagagtcaatctaggacttataattattcatcatgattttgagtagattgtaatcatcaagaatttttcatagatcgtttacttccaattgaatttagctcagaagtgattgcttttttttttttgagatggagtctcgcactgtcgccaggctggagtgcaatggtatgatgtcggctcactgcaacctctgcctcccgggttgaagcgatttcccctgcctcagcctcctgagtagctgggactacaggtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggccgaagatggtgttagtgattgcgagctgctggctggcacccttgcagagcaggagtaagtgagtgctgttcagctttccagtcctgaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcaga

SEQ ID NO: 304185 - DNA, 3570 bp, Homo sapiens
gattgcttcatagtatggtgtgctgttgccgtctgccacacctgtgttacagggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcaga

SEQ ID NO: 304186 - DNA, 4208 bp, Homo sapiens
tgagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacggcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcaga

SEQ ID NO: 304187 - DNA, 3818 bp, Homo sapiens
attaatcccatgaaaagcctgtagaaactgctacgacataactaattgattttgcattagggtgatcattcagttgacataaatctttctcacagtaaatttatataatatcgtaatgcccaagccttccattgtgtttgactacctcccctccctaaccttagtctggatgcagggtctttaaggtgtatgataaatgagctgtttactaatttcctgttgaagtgaatacacatttgcaattattggaatttattatttgggggcatctggctcatccttgtttttgtttgttaaacaggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcaga

SEQ ID NO: 304188 - DNA, 4477 bp, Homo sapiens
tgagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtcttttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcagaacagatgtgtaaattttttcttctctcttctggctttcatttcaaaaaccatttaaggtagtctttaaagcattttttatccttttttgtttgttttttttccaacttcttctattgaaaatttccaaagctacaataatataatgaacaactgtgtacctgtc

SEQ ID NO: 304189 - DNA, 2282 bp, Homo sapiens
tgagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaagcttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtattttta

SEQ ID NO: 304190 - DNA, 1211 bp, Homo sapiens
  misc_feature (8)..(8): n is a, c, g, or t
  misc_feature (10)..(10): n is a, c, g, or t
  misc_feature (12)..(12): n is a, c, g, or t
ccaaattngncnttggccggggagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgataggtctcactcattcacttcaaccacagagctggagagatcttcctgtacttaatggtctgtgcccgcccagaatatcagccaagctgaggtttattctcacatgggtgagaattcgatagaactgtgaaaaacaaggctctttaaatcgcttctctttcagataagtgaacttgttaattcttggtaactccaagggcctgttagattcgtttatttcaaacatctttattgtttcaccctgagtttagtaagtagttttttcttccttgtttcagaaacaacaaacgaacatcattgtctagtcttttctacctttctccatctttccccattctggctttgtgggtcatatcactaatgggccagaatttccacatgtattaatccagggaatttaagtgagatttttctgtttctttcttgctgtgactcagaggaataagaaagactctgaaaatgtaaaaataatgtcattgtttatatctcaaatgaatagaaaatattatctgaaagaagatagtagtgatttagaaaataatcaccagcaatctttaggccagtgatttttcaactttacaaaggcaggctactttgatacttttttggtggtgtggacgttattatcagaattgttaaattctaacaatcacataacattttgtgactttgtagcgcttagtattttctcaccacagtctaataaaatatagtatgataaagccagatttgaaactggcagtgtagttgcagtttctgagtttcattcttggcctttcttttttaaacaactttatttacataccataaagttcatccattttaagtgtacagtttagtgatttttatta

SEQ ID NO: 304191 - DNA, 886 bp, Homo sapiens
  misc_feature (817)..(817): n is a, c, g, or t
  misc_feature (867)..(867): n is a, c, g, or t
tgagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacggcccggcatcaaaattccaaanttatttattaaagaaccaattggttgccattgttcctaaaaattttaacnaaaaaccaattttattcct

SEQ ID NO: 304192 - DNA, 606 bp, Homo sapiens
  misc_feature (8)..(8): n is a, c, g, or t
  misc_feature (10)..(10): n is a, c, g, or t
  misc_feature (12)..(12): n is a, c, g, or t
ccaaattngncnttggccggggagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgataggtatgatgtagagacagtagatcagaatcagtgatacatatgtcgaagatgcacatttctacctaattcagtgtgggtcttctaagtgtgcaaatgccaagtggaatgggctttgccagtcgatttttcaaaatgtaattatttaatcatgtttattttgtgttttagtttaaaaacgtaagaacaaattaggtaatttgaattcttagaagttaaagttttatcttaatccatgatcgccca

SEQ ID NO: 304193 - DNA, 3598 bp, Homo sapiens
gagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaatcattgtatagactgacatccagttttcttcaactgtacactttctgcttagttttttttttttaagatgcagtaaataatactataaaaagtgttagtaatgattactgagttcaggaaaattttggtaaaatgtaaatattaaagccaatgtgaaaattt

SEQ ID NO: 304194 - DNA, 503 bp, Homo sapiens
tgtttaaacggacagaagtcctagcagctgtcattgctggtggagttattggctttctctttgcaatttttcttatcctgctgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttgactagtgctgctccaaaagtggaaaccacgacgctgaatatacagaacaagatacctgctcagacaaagtcacctgaagaaactgataaagagaaagttcacctctctgactcagaaaggaaaatgacccagccgaagacggatacaaacgct

SEQ ID NO: 304195 - DNA, 3560 bp, Homo sapiens
gagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaagggtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaatcattgtatagactgacatccagttttcttcaactgtacactttctgcttagttttttttttttaagatgcagtaaataatactataaaaagtgttagtaatgattactgagttcaggaaaattttggtaaaatgtaaatattaaagccaatgtgaaaattt

SEQ ID NO: 304196 - DNA, 3521 bp, Homo sapiens
gagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcaagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaatcattgtatagactgacatccagttttcttcaactgtacactttctgcttagttttttttttttaagatgcagtaaataatactataaaaagtgttagtaatgattactgagttcaggaaaattttggtaaaatgtaaatattaaagccaatgtgaaaattt

SEQ ID NO: 304197 - DNA, 3092 bp, Homo sapiens
ctagaacacaacggcggtcaagggagaggacgcagaaagatcaggctcaggcctgggtcttgggcatcttcaaggaactcgctttctcagtggtataagaagagccccactctataagaggcatccaacaggaacagccaacatcagtggcaccttccaaagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaatcattgtatagactgacatccagttttcttcaactgtacactttctgcttagttttttttttttaagatgcagtaaataatactataaaaagtgttagtaatgattactgagttcaggaaaattttggtaaaatgtaaatattaaagccaatgtgaaaattt

SEQ ID NO: 304198 - DNA, 3544 bp, Homo sapiens
gagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactactaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaatcattgtatagactgacatccagttttcttcaactgtacactttctgcttagttttttttttttaagatgcagtaaataatactataaaaagtgttagtaatgattactgagttcaggaaaattttggtaaaatgtaaatattaaagccaatgtgaaaattt

SEQ ID NO: 304199 - DNA, 2557 bp, Homo sapiens
  misc_feature (2493)..(2493): n is a, c, g, or t
gagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatataaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaacaaaaaaaaaaaaaaacaaaaaaaccaaaccaacacaaacccaaaacacccaacacaacaaccaaccccaaaaaaaaacacccncccccccacacaaaccacccccccttcccctcaacccctcctcccacacccttcccatcgggct

SEQ ID NO: 304200 - DNA, 2435 bp, Homo sapiens
gagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattctgtgcttataaaataccaactttttttttaaactgttacatatactcattaacaccagtctgcaacaagttacatagaatcagaggctcttcggaggcttaaaaagacgtttacaacttaaatgcattttta

SEQ ID NO: 304201 - DNA, 2300 bp, Homo sapiens
aagcttgatatcgaattcggcacgagctcgtgccgtttaatacaatgggattttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaatcattgtatagactgacatccagttttcttcaactgtacactttctgcttagttttttttttttaagatgcagtaaataatactataaaaagtgttagtaatgattactgagttcaggaaaattttggtaaaatgtaaatattaaagccaatgtgaaaattt

SEQ ID NO: 304202 - DNA, 1968 bp, Homo sapiens
ccggaccggtacttaaaaattacctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaatcattgtatagactgacatccagttttcttcaactgtacactttctgcttagttttttttttttaagatgcagtaaataatactataaaaagtgttagtaatgattactgagttcaggaaaattttggtaaaatgtaaatattaaagccaatgtgaaaattt

SEQ ID NO: 304203 - DNA, 1612 bp, Homo sapiens
gagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataaaaaaaaaaaaaaaccctggacccttgcccaatttgggggccccccgggccgcccgaataaccccaagggggagcgcaggaccgaaaggagggggtggagaccttcgcggacccggctacccgggggctcccttccaaagacttcggccgcctgcgggggacgcggagttgtgtcccgcccaacccttcactatactcaacagggtttaaccatcccggacgtacccggcatgaacacagaaggagttactatgcccgggggccccgcagatatctgcgaactcacgcgatcacctcatgccctaaaaaatctagaccggaatacttctaga

SEQ ID NO: 304204 - DNA, 1911 bp, Homo sapiens
ctttttatcattggactcatcatttaatcttgatttccagcttctcacacttgaaagaagacataatacatttctcacaggattctgggactattaactgaacttatgtgtgtaaaaggaattcatacaatgaaagcactagaaataattattatacttataaccattgtatttttacatgtttaaaatatagccataattagcctactcaaatccaagtgtaaaagtaaaatgatttgctttcgttttgttttccttgcttaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataataaatgtcttttaaagatggcctgtggttatcttggaaattggtgatttatgctagaaagcttttaatgttggtttattgttgaattcctagaaaagttttatgggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattactttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccc

SEQ ID NO: 304205 - DNA, 326 bp, Homo sapiens
ttcccctgcagactttggaagtgagagcacttcctcatagaccttggatgtgggaggattgcattcagtctagttcctggttgccggctgaaataacctgacgtgtacagaagggccatgctgttattactcttacacaaggaggcagccctcgagccacagggtccagctgttggctataatagcctaccggtctctgatgatcaccatgtttctggaattcaagccaggaagaagcagcaatctgtcttctggattaaaactgaagatcaacctactttcaacttactaagaaaggtattaagcgcctttctgagagctctcag

SEQ ID NO: 304206 - DNA, 1826 bp, Homo sapiens
ttcccctgcagactttggaagtgagagcacttcctcatagaccttggatgtgggaggattgcattcagtctagttcctggttgccggctgaaataacctgaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataataaatgtcttttaaagatggcctgtggttatcttggaaattggtgatttatgctagaaagcttttaatgttggtttattgttgaattcctagaaaagttttatgggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattactttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccc

SEQ ID NO: 304207 - DNA, 2210 bp, Homo sapiens
ttcccctgcagactttggaagtgagagcacttcctcatagaccttggatgtgggaggattgcattcagtctagttcctggttgccggctgaaataacctgctctccaaaatgtccacaaaagtgacttaagtcaggttcccccaaaccagacaccaagacaagaatccatgtgtgtgtgactgaaggaagtgctgggagagccccagctgcagcctggatgtgaactgcaactccaaagtgtgtccagactcaaggcaagggcactaggctttccagacctcctactaagtcattgatccagcactgccctgccaggacataaatccctggcacctcttgctctctgcaaaggagggcaaagcagcttcaggagcccttgggagtcctccaaagagagtctagggtacaggtccgaaagtagaagaacacagaaggcaggccaggggcactgtgagatggtaaaagagatctgaagggatccagaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataataaatgtcttttaaagatggcctgtggttatcttggaaattggtgatttatgctagaaagcttttaatgttggtttattgttgaattcctagaaaagttttatgggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattactttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccc

SEQ ID NO: 304208 - DNA, 1733 bp, Homo sapiens
acgagttagtctggtgcgctaataccgaatcagcagagagccgcacgtctctggataaactgagatcaactacttcactactagaagggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataataaatgtcttttaaagatggcctgtggttatcttggaaattggtgatttatgctagaaagcttttaatgttggtttattgttgaattcctagaaaagttttatgggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattactttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccc

SEQ ID NO: 304209 - DNA, 1976 bp, Homo sapiens
ttcccctgcagactttggaagtgagagcacttcctcatagaccttggatgtgggaggattgcattcagtctagttcctggttgccggctgaaataacctgaccgagagcatcaccccctgaacatggacttgcagaattccacagaagagaggagactggcctagacagacagccccaggagctgagggcccaacaggctttctaccctggatgctgctcccatgccctgacatgaggcccactacaatgaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataataaatgtcttttaaagatggcctgtggttatcttggaaattggtgatttatgctagaaagcttttaatgttggtttattgttgaattcctagaaaagttttatgggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattactttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccc

SEQ ID NO: 304210 - DNA, 1145 bp, Homo sapiens
ttcccctgcagactttggaagtgagagcacttcctcatagaccttggatgtgggaggattgcattcagtctagttcctggttgccggctgaaataacctgaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatgataggtcgtcagttgataactggtgagctggatgacaaatagacaagattgttttactccttattctaaatagtaaaaaatctaacaccatgtttgggcacaagctttct

SEQ ID NO: 304211 - DNA, 711 bp, Homo sapiens
ttcccctgcagactttggaagtgagagcacttcctcatagaccttggatgtgggaggattgcattcagtctagttcctggttgccggctgaaataacctgaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggatgtggtactaagccccctccccctcttccgtacctccaccctaggtgcgcctccc

SEQ ID NO: 304212 - DNA, 460 bp, Homo sapiens
cccaaagtgctgggattacaggcgtgagccaccacactagggacgaagttttattatggccgaaggacacttactggagagggtctccaggaggtatgaatgacaaaaacaattaactccttcaccgtcagaccgagagcatcaccccctgaacatggacttgcagaattccacagaagagaggagactggcctagacagacagccccaggagctgagggcccaacaggctttctaccctggatgctgctcccatgccctgacatgaggcccactacaatggtatacttgtatgctctttcctaattaagaaacaaacaaacaaaaaatcagacatactgtttgctcttgaatgcttgaaacacaaaacaggtgacaccaccttcctcctcaaaaggaactttttaactgtcaactttctacgtgcacgctgcccagagacttattttgtctggcccttg

SEQ ID NO: 304213 - DNA, 513 bp, Homo sapiens
ctgggaaccgggagtagtccaatcagctcttttaccaatgaacacttccttgtgatatagatgtttatggccgagaggatccagtatattaataaaatccctttttgtattcaatgagggaaacacataattttcatcaattagcagcttattggaatatctgcatgatggtttaacacttttaagtgttgactaaagattaattttacagaaaatagaaaaagaaatatgtttctgtctggaggaatgatttattgttgaccctaaattgaaatattttactagtggcttaatggaaagatgatgaaagatgatgaaattaatgtagaagcttaactagaaaatcaggtgacctgatatctacatctgtatccttcattggccacccagcattcattaatgaatcagatgatggaatagatcaagtttcctaggaacacagtgaatattaaaagaaaacaaagggagcctagcacctagaagacctagtttatatttcaaagtatatttgga

SEQ ID NO: 304214 - DNA, 377 bp, Homo sapiens
tacatctgtatccttcattggccacccagcattcattaatgaatcagatgatggaatagatcaagtttcctaggaacacagtgaatattaaaagaaaacaaagggagcctagcacctagaagacctagtttatatttcaaagtatatttggatgtaacccaattttaaacatttcctcacttgtctctcttaaagccttgccaacagcaaggacagagaaccaaaaatagtgtatatatgaataaatgcttattacagaatctgctgactggcacatgctttgtgtgtaatgggttctcataaacacttgttgaatgaacacacataagtgaaagagcatggctaggcttcatcccttggtcaaatatggggtgcta

SEQ ID NO: 304215 - DNA, 1084 bp, Homo sapiens
ggtgtaagtagctgattaagtgttagaatgcaaacagctagaatccatgtttcaggtattaagttttaaacaagtactaaaacagcttttgaaactcatatatttatagctttgccatgcattaatgcaatataaatttccttcctttacaggtggatgattgtggcttttctttgaatcatcctaatcagttcttttgtgagagccaacgtattctaaatggtggtaaagacataaagaaggaacctatccaaccagaaactcctcaacccaaaccaagtgtccagaaaaccaaggatgcatcatctgctctggcctctttaaattcctctctggaaatggatatggaaggactagaagattactttagtgaagattcttaggcagttttataaccctttttcctcaatagcctgtttcctgtttttaagattttgcctttgttgttgaaaaagggtttcactctgtcaccaaggcttagtgcagtgacacaattacagctgattgcagccttgaccttcccagctcaagtgatcctcctacctcagcctcccaagtagttgggaccacaggtgtgcacctcatatccagataatttttttcaatttttttttgtagaggtggggggtctccctatgttgcccaggcagatctcagactcctgggctcaagcgatcctcacacctcagcgtcccagagtgctgggattacagttgtgagccactgtgcctggcctttttttttttttaacctttttgtttaacttctctcttcactgcatcccaatccatctacaggcatgcacacttattaggaaaggaggtttgaggtaacaacagagactttcactatattttgctttgacagaaggaaagaggaggagtttctattaaaatctgtcacttgagtgatgtcatttaagtcctattttaggagataaaaacagctttggggactggttaaagtcccccagaaactacaataaagaacaacttttgttttaactcttaatcactttgtaattttgactcaatccttttctggaccatttttgttaataaatatcaaagtgtaaaagacagtg

SEQ ID NO: 304216 - DNA, 2325 bp, Homo sapiens
ctcttccggtttcatatgaactctcccgccacccgggaacagtggctgccaccgtttgtgttttcccgagtttgaattcttgcaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctataagtgatgaagagaagactcttcgagaacaggagattgttgcctcatcaccaagtttaagtggacttaagttggggttcgagtccatttataagatcccttttgctgatgctctggatttgtttcgaggaaggaaagtctatttggaagatggctttgcttacgtaccacttaaggacattgtggcaatcatcctgaatgaatttagagccaaactgtccaaggctttggcattaacagccaggtccttgcctgctgtgcagtctgatgaaagacttcagcctctgctcaatcacctcagtcattcctacactggccaagattacagtacccagggaaatgttgggaagatttctttagatcagattgatttgctttctaccaaatccttcccaccttgcatgcgtcagttacataaagccttgcgggaaaatcaccatcttcgtcatggaggccgaatgcagtatggcctatttctgaagggcattggtttaactttggaacaggcattgcagttctggaagcaagaatttatcaaaggaaagatggatccagacaagtttgataaaggttactcttacaacatccgtcacagctttggaaaggaaggcaagaggacagactatacacctttcagttgcctgaagattattctgtccaatccaccaagccaaggggattatcatgggtgcccattccgtcacagtgatccagagctgctgaagcaaaagttgcagtcatacaagatctctcctggagggataagccagattttggatttagtaaaggggacacattaccaggtagcctgtcaaaaatactttgagatgatacacaatgtggatgattgtggcttttctttgaatcatcctaatcagttcttttgtgagagccaacgtattctaaatggtggtaaagacataaagaaggaacctatccaaccagaaactcctcaacccaaaccaagtgtccagaaaaccaaggatgcatcatctgctctggcctctttaaattcctctctggaaatggatatggaaggactagaagattactttagtgaagattcttaggcagttttataaccctttttcctcaatagcctgtttcctgtttttaagattttgcctttgttgttgaaaaagggtttcactctgtcaccaaggcttagtgcagtgacacaattacagctgattgcagccttgaccttcccagctcaagtgatcctcctacctcagcctcccaagtagttgggaccacaggtgtgcacctcatatccagataatttttttcaatttttttttgtagaggtggggggtctccctatgttgcccaggcagatctcagactcctgggctcaagcgatcctcacacctcagcgtcccagagtgctgggattacagttgtgagccactgtgcctggcctttttttttttttaacctttttgtttaacttctctcttcactgcatcccaatccatctacaggcatgcacacttattaggaaaggaggtttgaggtaacaacagagactttcactatattttgctttgacagaaggaaagaggaggagtttctattaaaatctgtcacttgagtgatgtcatttaagtcctattttaggagataaaaacagctttggggactggttaaagtcccccagaaactacaataaagaacaacttttgttttaactcttaatcactttgtaattttgactcaatccttttctggaccatttttgttaataaatatcaaagtgtaaaagacagtg

SEQ ID NO: 304217 - DNA, 1160 bp, Homo sapiens
ctcttccggtttcatatgaactctcccgccacccgggaacagtggctgccaccgtttgtgttttcccgagtttgaattcttgcaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctataagtgatgaagagaagactcttcgagaacaggagattgttgcctcatcaccaagtttaagtggacttaagttggggttcgagtccatttataagatcccttttgctgatgctctggatttgtttcgaggaaggaaagtctatttggaagatggctttgcttacgtaccacttaaggacattgtggcaatcatcctgaatgaatttagagccaaactgtccaaggctttggcagtgagtattttacttgatttctgtatctgacatgttcacactttcagttatatacccctggtagttttattctgtgtttctctaggaaataagttaattcagttttcataatgatattcagattacatatgatgttgtactgttaatcccaaaattcctaggtttttatttgttactatccatagttggtttttaagttttttttcttgatcctactaataccaatgctgagtgattaattttgtgagtaacctctgtgggtttcttcatggtcatgtcttttttccttagaaatagacttcgtatatggctcttaacaattagtgtggcctgtggtagatataactcctagatttctgttctgaattagtat

SEQ ID NO: 304218 - DNA, 889 bp, Homo sapiens
ctcttccggtttcatatgaactctcccgccacccgggaacagtggctgccaccgtttgtgttttcccgagtttgaattcttgcaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctgtaagtatattttgtagttatttctaattgttctcaccattcatttttcccttctgtcttaagtgctggtactaatgtgtagtgtgttctctttacattctccaagtacctgcctgaaacagtagctaatagctttggataacaatatatctttccttctctatgactagaagaaaaggactccttaataacaaagtctcacacttacttgctctgttaaatgtgtgctttattaaagcacaagaaggtttagtttataaaggttcatctttaaccaaaattttgtcggccaaaataaagctaataatgtgttaaactagacaagtggtagtttct

SEQ ID NO: 304219 - DNA, 925 bp, Homo sapiens
acagtgatttactgaacatggctgctgaaatgtataacattattgtgcattattgctaccgtgatatgcggatttatattgcaattgcctctggattcagaaaaacacccttcacagtgaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctgtaagtatattttgtagttatttctaattgttctcaccattcatttttcccttctgtcttaagtgctggtactaatgtgtagtgtgttctctttacattctccaagtacctgcctgaaacagtagctaatagctttggataacaatatatctttccttctctatgactagaagaaaaggactccttaataacaaagtctcacacttacttgctctgttaaatgtgtgctttattaaagcacaagaaggtttagtttataaaggttcatctttaaccaaaattttgtcggccaaaataaagctaataatgtgttaaactagacaagtggtagtttct

SEQ ID NO: 304220 - DNA, 178 bp, Homo sapiens
aacaacatgggaaacaataaaacaagaaccagaacaccctgcgtctcaggcagaagaagaggaaaatgatgaatagtagaagctccgcctgtgaagatgattttacctgcagctgaaataccatgacccagatattgaacacacagaataattaaacttttcgtctagaaactttgtg

SEQ ID NO: 304221 - DNA, 1697 bp, Homo sapiens
catgaagagatgcatgctctttttgtaaatgctaattgttttaaaagttgaaaagaaaacctttggaaaactcagaaatcttccttgaaataattttactcagagcattggcctctccctggtttaggaatcattcttgccagagattcaatctcgaaattaacagccaggtccttgcctgctgtgcagtctgatgaaagacttcagcctctgctcaatcacctcagtcattcctacactggccaagattacagtacccagggaaatgttgggaagatttctttagatcagattgatttgctttctaccaaatccttcccaccttgcatgcgtcagttacataaagccttgcgggaaaatcaccatcttcgtcatggaggccgaatgcagtatggcctatttctgaagggcattggtttaactttggaacaggcattgcagttctggaagcaagaatttatcaaaggaaagatggatccagacaagtttgataaaggttactcttacaacatccgtcacagctttggaaaggaaggcaagaggacagactatacacctttcagttgcctgaagattattctgtccaatccaccaagccaaggggattatcatgggtgcccattccgtcacagtgatccagagctgctgaagcaaaagttgcagtcatacaagatctctcctggagggataagccagattttggatttagtaaaggggacacattaccaggtagcctgtcaaaaatactttgagatgatacacaatgtggatgattgtggcttttctttgaatcatcctaatcagttcttttgtgagagccaacgtattctaaatggtggtaaagacataaagaaggaacctatccaaccagaaactcctcaacccaaaccaagtgtccagaaaaccaaggatgcatcatctgctctggcctctttaaattcctctctggaaatggatatggaaggactagaagattactttagtgaagattcttaggcagttttataaccctttttcctcaatagcctgtttcctgtttttaagattttgcctttgttgttgaaaaagggtttcactctgtcaccaaggcttagtgcagtgacacaattacagctgattgcagccttgaccttcccagctcaagtgatcctcctacctcagcctcccaagtagttgggaccacaggtgtgcacctcatatccagataatttttttcaatttttttttgtagaggtggggggtctccctatgttgcccaggcagatctcagactcctgggctcaagcgatcctcacacctcagcgtcccagagtgctgggattacagttgtgagccactgtgcctggcctttttttttttttaacctttttgtttaacttctctcttcactgcatcccaatccatctacaggcatgcacacttattaggaaaggaggtttgaggtaacaacagagactttcactatattttgctttgacagaaggaaagaggaggagtttctattaaaatctgtcacttgagtgatgtcatttaagtcctattttaggagataaaaacagctttggggactggttaaagtcccccagaaactacaataaagaacaacttttgttttaactcttaatcactttgtaattttgactcaatccttttctggaccatttttgttaataaatatcaaagtgtaaaagacagtg

SEQ ID NO: 304222 - DNA, 2395 bp, Homo sapiens
gagcacttcacgcccttactggtgtctggcccagcccgggtcgccccttccccagtcgggacttggggcaggcaaaaagccgaacgttcggccagactggggacgcagcgccgccctcgctccacccctctttcccgcccaccaggcaattccaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctataagtgatgaagagaagactcttcgagaacaggagattgttgcctcatcaccaagtttaagtggacttaagttggggttcgagtccatttataagatcccttttgctgatgctctggatttgtttcgaggaaggaaagtctatttggaagatggctttgcttacgtaccacttaaggacattgtggcaatcatcctgaatgaatttagagccaaactgtccaaggctttggcattaacagccaggtccttgcctgctgtgcagtctgatgaaagacttcagcctctgctcaatcacctcagtcattcctacactggccaagattacagtacccagggaaatgttgggaagatttctttagatcagattgatttgctttctaccaaatccttcccaccttgcatgcgtcagttacataaagccttgcgggaaaatcaccatcttcgtcatggaggccgaatgcagtatggcctatttctgaagggcattggtttaactttggaacaggcattgcagttctggaagcaagaatttatcaaaggaaagatggatccagacaagtttgataaaggttactcttacaacatccgtcacagctttggaaaggaaggcaagaggacagactatacacctttcagttgcctgaagattattctgtccaatccaccaagccaaggggattatcatgggtgcccattccgtcacagtgatccagagctgctgaagcaaaagttgcagtcatacaagatctctcctggagggataagccagattttggatttagtaaaggggacacattaccaggtagcctgtcaaaaatactttgagatgatacacaatgtggatgattgtggcttttctttgaatcatcctaatcagttcttttgtgagagccaacgtattctaaatggtggtaaagacataaagaaggaacctatccaaccagaaactcctcaacccaaaccaagtgtccagaaaaccaaggatgcatcatctgctctggcctctttaaattcctctctggaaatggatatggaaggactagaagattactttagtgaagattcttaggcagttttataaccctttttcctcaatagcctgtttcctgtttttaagattttgcctttgttgttgaaaaagggtttcactctgtcaccaaggcttagtgcagtgacacaattacagctgattgcagccttgaccttcccagctcaagtgatcctcctacctcagcctcccaagtagttgggaccacaggtgtgcacctcatatccagataatttttttcaatttttttttgtagaggtggggggtctccctatgttgcccaggcagatctcagactcctgggctcaagcgatcctcacacctcagcgtcccagagtgctgggattacagttgtgagccactgtgcctggcctttttttttttttaacctttttgtttaacttctctcttcactgcatcccaatccatctacaggcatgcacacttattaggaaaggaggtttgaggtaacaacagagactttcactatattttgctttgacagaaggaaagaggaggagtttctattaaaatctgtcacttgagtgatgtcatttaagtcctattttaggagataaaaacagctttggggactggttaaagtcccccagaaactacaataaagaacaacttttgttttaactcttaatcactttgtaattttgactcaatccttttctggaccatttttgttaataaatatcaaagtgtaaaagacagtg

SEQ ID NO: 304223 - DNA, 2287 bp, Homo sapiens
ctcttccggtttcatatgaactctcccgccacccgggaacagtggctgccaccgtttgtgttttcccgagtttgaattcttgcaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctataagtgatgaagagaagactcttcgagaacaggagattgttgcctcatcaccaagtttaagtggacttaagttggggttcgagtccatttataagatcccttttgctgatgctctggatttgtttcgaggaaggaaagtctatttggaagatggctttgcttacgtaccacttaaggacattgtggcaatcatcctgaatgaatttagagccaaactgtccaaggctttggcattaacagccaggtccttgcctgctgtgcagtctgatgaaagacttcagcctctgctcaatcacctcagtcattcctacactggccaagattacagtacccagggaaatgttgggaagatttctttagatcagattgatttgctttctaccaaatccttcccaccttgcatgcgtcagttacataaagccttgcgggaaaatcaccatcttcgtcatggaggccgaatgcagtatggcctatttctgaagggcattggtttaactttggaacaggcattgcagttctggaagcaagaatttatcaaaggaaagatggatccagacaagtttgataaaggttactcttacaacatccgtcacagctttggaaaggaaggcaagaggacagactatacacctttcagttgcctgaagattattctgtccaatccaccaagccaaggggattatcatgggtgcccattccgtcacagtgatccagagctgctgaagcaaaagttgcagtcatacaagatctctcctggagggataagccagattttggatttagtaaaggggacacattaccaggtagcctgtcaaaaatactttgagatgatacacaatgtggatgattgtggcttttctttgaatcatcctaatcagttcttttgtgagagccaacgtattctaaatggtggtaaagacataaagaaggaacctatccaaccagaaactcctcaacccaaaccaagtgtccagaaaaccaaggatgcatcatctgctctggcctctttaaattcctctctggaaatggatatggaaggactagaagattactttagtgaagattcttaggcagttttataaccctttttcctcaatagcctgtttcctgtttttaagattttgcctttgttgttgaaaaagggtttcactctgtcaccaaggcttagtgcagtgacacaattacagctgattgcagccttgaccttcccagctcaagtgatcctcctacctcagcctcccaagtagttgggaccacaggtgtgcacctcatatccagataatttttttcaatttttttttgtagaggtggggggtctccctatgttgcccaggcagatctcagactcctgggctcaagcgatcctcacacctcagcgtcccagagtgctgggattacagttgtgagccactgtgcctggcctttttttttttttaacctttttgtttaacttctctcttcactgcatcccaatccatctacaggcatgcacacttattaggaaaggaggtttgaggtaacaacagagactttcactatattttgctttgacagaaggaaagaggaggagtttctattaaaatctgtcacttgagtgatgtcatttaagtgacagattttgacagaaggaaagaggaggagtttctattaaaatctgtcacttgagtgatgtcatttaagtcctattttaggagataaaaacggctttgggactttaaccagtccccgtcgac

SEQ ID NO: 304224 - DNA, 983 bp, Homo sapiens
cccacccatcagaatttcacccacgagacgcgatgttaccaccaccagtgagtggatgattgtggcttttctttgaatcatcctaatcagttcttttgtgagagccaacgtattctaaatggtggtaaagacataaagaaggaacctatccaaccagaaactcctcaacccaaaccaagtgtccagaaaaccaaggatgcatcatctgctctggcctctttaaattcctctctggaaatggatatggaaggactagaagattactttagtgaagattcttaggcagttttataaccctttttcctcaatagcctgtttcctgtttttaagattttgcctttgttgttgaaaaagggtttcactctgtcaccaaggcttagtgcagtgacacaattacagctgattgcagccttgaccttcccagctcaagtgatcctcctacctcagcctcccaagtagttgggaccacaggtgtgcacctcatatccagataatttttttcaatttttttttgtagaggtggggggtctccctatgttgcccaggcagatctcagactcctgggctcaagcgatcctcacacctcagcgtcccagagtgctgggattacagttgtgagccactgtgcctggcctttttttttttttaacctttttgtttaacttctctcttcactgcatcccaatccatctacaggcatgcacacttattaggaaaggaggtttgaggtaacaacagagactttcactatattttgctttgacagaaggaaagaggaggagtttctattaaaatctgtcacttgagtgatgtcatttaagtcctattttaggagataaaaacagctttggggactggttaaagtcccccagaaactacaataaagaacaacttttgttttaactcttaatcactttgtaattttgactcaatccttttctggaccatttttgttaataaatatcaaagtgtaaaagacagtg

SEQ ID NO: 304225 - DNA, 1629 bp, Homo sapiens
ctcttccggtttcatatgaactctcccgccacccgggaacagtggctgccaccgtttgtgttttcccgagtttgaattcttgcaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctataagtgatgaagagaagactcttcgagaacaggagattgttgcctcatcaccaagtttaagtggacttaagttggggttcgagtccatttataagatcccttttgctgatgctctggatttgtttcgaggaaggaaagtctatttggaagatggctttgcttacgtaccacttaaggacattgtggcaatcatcctgaatgaatttagagccaaactgtccaaggctttggcattaacagccaggtccttgcctgctgtgcagtctgatgaaagacttcagcctctgctcaatcacctcagtcattcctacactggccaagattacagtacccagggaaatgttgggaagatttctttagatcagattgatttgctttctaccaaatccttcccaccttgcatgcgtcagttacataaagccttgcgggaaaatcaccatcttcgtcatggaggccgaatgcagtatggcctatttctgaagggcattggtttaactttggaacaggcattgcagttctggaagcaagaatttatcaaaggaaagatggatccagacaagtttgataaaggttactcttacaacatccgtcacagctttggaaaggaaggcaagaggacagactatacacctttcagttgcctgaagattattctgtccaatccaccaagccaaggggattatcatgggtgcccattccgtcacagtgatccagagctgctgaagcaaaagttgcagtcatacaagatctctcctggagggataagccagatgagaaagctgaggtttggagaaggcaagaaactgctcagaaccatagaactaatatatgataaggccagaattcgcacctatgcctgacagtgaagctgaagtttcttacaatacattgttctgattctctgtagtatttttctattttaaatccagttgaaattctttttggtttcttctttcatggaaagccatcactgtgaagtgaatggtaattcttatgtacctaaacttaagaaaatgtataatgcattgttgaaacactgacaaatgtgaaacaaagatgagaataattcagaaaa

SEQ ID NO: 304226 - DNA, 1237 bp, Homo sapiens
ctcttccggtttcatatgaactctcccgccacccgggaacagtggctgccaccgtttgtgttttcccgagtttgaattcttgcaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctataagtgatgaagagaagactcttcgagaacaggagattgttgcctcatcaccaagtttaagtggacttaagttggggttcgagtccatttataagatcccttttgctgatgctctggatttgtttcgaggaaggaaagtctatttggaagatggctttgcttacgtaccacttaaggacattgtggcaatcatcctgaatgaatttagagccaaactgtccaaggctttggcattaacagccaggtccttgcctgctgtgcagtctgatgaaagacttcagcctctgctcaatcacctcagtcattcctacactggccaagattacagtacccagggaaatgttgggaagatttctttagatcagattgatttgctttctaccaaatccttcccaccttgcatgcgtcagttacataaagccttgcgggaaaatcaccatcttcgtcatggaggccgaatgcagtatggcctatttctgaagggcattggtttaactttggaacaggcattgcagttctggaagcaagaatttatcaaaggaaagatggatccagacaaggaagaggaaaatgatgaatagtagaagctccgcctgtgaagatgattttacctgcagctgaaataccatgacccagatattgaacacacagaataattaaacttttcgtctagaaactttgtg

SEQ ID NO: 304227 - DNA, 1245 bp, Homo sapiens
ctcttccggtttcatatgaactctcccgccacccgggaacagtggctgccaccgtttgtgttttcccgagtttgaattcttgcaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaattgttaaaatcagttgaaaatcttggagtgagctatgtgaaaggaactgaacaataccagagtaagttggagagtgagcttcggaagctcaagttttcctacagagaaaacttagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctataagtgatgaagagaagactcttcgagaacaggagattgttgcctcatcaccaagtttaagtggacttaagttggggttcgagtccatttataagatcccttttgctgatgctctggatttgtttcgaggaaggaaagtctatttggaagatggctttgcttacgtaccacttaaggacattgtggcaatcatcctgaatgaatttagagccaaactgtccaaggctttggcaatatggagtcttgccatgttgcccaggctggtcttgaactcctagcctcaagtgatccacccacctcagcctccgaaagtgctgggattataggcactaggcggcatgcctgggccctctactctgttctgaataaaaagtctctggggatggaccctaggtgattcataggcacactgaaatctgagaaccaggtacaggaaataaaattatttgaaatgcaaaccattgaattttatgactttttcattgcttttggtaagaggctggactgtggaggagatgaaaacttgaccaaaaatggatttctgtgagcaccacagaatttggtgaggtttagtaggactccggaggaataacattcgggaaggacaggatgtctgaactgtatgaccagtcctgtcctttttgctgttctctccctgagactcttttttcacctggatgattccttcccc

SEQ ID NO: 304228 - DNA, 220 bp, Homo sapiens
ttaacagccaggtccttgcctgctgtgcagtctgatgaaagacttcagcctctgctcaatcacctcaggtaatctaaaggcacagccttgttatgcttataaatccaagtgcagtaaagtgaataaagtatattaaagtggtgaaaccgcttcaattactaaaaacttatttttttttcttgctttcattccattattcaaattgaagttcttagtacca

SEQ ID NO: 304229 - DNA, 3948 bp, Homo sapiens
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaa

SEQ ID NO: 304230 - DNA, 2609 bp, Homo sapiens
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttc

SEQ ID NO: 304231 - DNA, 2550 bp, Homo sapiens
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcaatggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaac

SEQ ID NO: 304232 - DNA, 712 bp, Homo sapiens
ggaagaggctgacgattttactatctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccagggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagtgagaattagtttctagtactc

SEQ ID NO: 304233 - DNA, 932 bp, Homo sapiens
ggaagaggctgacgattttactatctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccagggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatctccttctggtgggatcgcctccggtagggctcgaaggtttttgggcgcctcttcgggatggggtcaaagaggtggccccgtgtagggcccggagattctctgcccaaaaagaatggccggggaagacaccagacgtggagacctccctgggcccattggttgaaacccccactta

SEQ ID NO: 304234 - DNA, 533 bp, Homo sapiens
ggaagaggctgacgattttactatctcatttttttcctttctccagaatgggttctgggtgggtcccctgggtggtggctctgctagtgaatctgacccgactggattcctccatgactcaaggcacagactctccaggtaagaacagagcaattgtttttttccagtgtgtatgcaagaattggcatgggggagtgatgcctttctttgtaagtccaggccacagaccagactggaagtggcttttggtttcaaagaacagtgttcttccctttggcagaaaggtacgccttgcctctttacatgggatggacttcatataccagagccacctattcaaggggtagggaggcaggaagagggaaacattgtgtcttgtttaggatccttattgtgtgtatcaacctcagtcagtgcctgggcgtgttgaaggccttggcttgggttcgagcctgctgggagaaacaacctgcagtaggctgggtcacagaggcaatctgtgatttttggtcaggacacggaaacaaatctca

SEQ ID NO: 304235 - DNA, 3771 bp, Homo sapiens
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaa

SEQ ID NO: 304236 - DNA, 3894 bp, Homo sapiens
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaatcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaa

SEQ ID NO: 304237 - DNA, 180 bp, Homo sapiens
tgtgaggagttgggagggtggtttctggtagaagtgtgtttaattagccggctctcccattcctgttttccagaccctggtatacatatatggggatatgctcagcaacgtgggagctgcagagaaggttttctcctacatggaccgacagccaaatctgccttcacctggcacgcttgc

SEQ ID NO: 304238 - DNA, 486 bp, Homo sapiens
caaatctgccttcacctggcacgcttgcccccaccactctgcagggggttgtgaaattccaagacgtctcctttgcatatcccaatcgccctgacaggcctgtgctcaaggtgcctgaaagagggaggaaacctggacccttgctctctgctgctaatgcataattggacatcacagcctatagttcatttgcctctgagaacctggtcttgcctctgctaagaagagaaatggagggattttgagggagaaggggcaggcccttaactctttttctggttttctaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtgggtgaggagggagaagacaggg

SEQ ID NO: 304239 - DNA, 3216 bp, Homo sapiens
  misc_feature (2040)..(2040): n is a, c, g, or t
tcgatttacaagcacttattttattttacttcatttcacatgcacgtctgttttacgcagttacttgtttacacgctcttcttctagactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtaagtattagagacagaaaaagtatgaagtcccttctgtgaggactaacaatagtgatgccattttacaaccttgatgactgtgttctcaagaaacaaagcaaatgtcaaccccgtccatagcttcaacagagcataacagctctaaccgcaacagagcctaacggccctaaccacatctgtccccagttggaaagtgtccaaacagttccaactagccagcacttccccaacccctccccaacagaaactttattataaaagcctcagcttgtaagcgatcaggatctcagccagattcctaactggaactcttcgcaggcttttcctgtaaataaacctgtttggccgtggaattgcctcctgttactcgctctctacgtttatatcttcctaacaccttccggctctaatgttttgggtctcgatgaccatctaactcctaaatgctgggggccgctccccatagaaatgcctcgccggatttctccgcctcgcacccagtgggactgggatttttggccccggggtttgcaataagggagtcaccaagcagcagccacctctggaattcctagaaaggaaagagttgcctggcttcagccagtgggctcagaacggctgacgcatttccggcctttgcggttgatcggtcattggggtgctgcagccccgccacctgttccgtagcttgccggtgccccgaaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttnctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatgtgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgcccta

SEQ ID NO: 304240 - DNA, 3692 bp, Homo sapiens
  misc_feature (2516)..(2516): n is a, c, g, or t
tcgatttacaagcacttattttattttacttcatttcacatgcacgtctgttttacgcagttacttgtttacacgctcttcttctagactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtaagtattagagacagaaaaagtatgaagtcccttctgtgaggactaacaatagtgatgccattttacaaccttgatgactgtgttctcaagaaacaaagcaaatgtcaaccccgtccatagcttcaacagagcataacagctctaaccgcaacagagcctaacggccctaaccacatctgtccccagttggaaagtgtccaaacagttccaactagccagcacttccccaacccctccccaacagaaactttattataaaagcctcagcttgtaagcgatcaggatctcagccagattcctaactggaactcttcgcaggcttttcctgtaaataaacctgtttggccgtggaattgcctcctgttactcgctctctacgtttatatcttcctaacaccttccggctctaatgttttgggtctcgatgaccatctaactcctaaatgctgggggccgctccccatagaaatgcctcgccggatttctccgcctcgcacccagtgggactgggatttttggccccggggtttgcaataagggagtcaccaagcagcagccacctctggaattcctagaaaggaaagagttgcctggcttcagccagtgggctcagaacggctgacgcatttccggcctttgcggttgatcggtcattggggtgctgcagccccgccacctgttccgtagcttgccggtgccccgaaggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttnctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatgtgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgcccta

SEQ ID NO: 304241 - DNA, 3044 bp, Homo sapiens
  misc_feature (1868)..(1868): n is a, c, g, or t
agagaaaaactgctgaccctgtaagagagaactggccatcttgcagacagacagagccccgagtgttctttcaactacctgccacccatccaacaactcccctcggacctcagtatgggctggaacctgacacttggcatgacagtgactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttnctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatgtgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgcccta

SEQ ID NO: 304242 - DNA, 3478 bp, Homo sapiens
  misc_feature (2516)..(2516): n is a, c, g, or t
tcgatttacaagcacttattttattttacttcatttcacatgcacgtctgttttacgcagttacttgtttacacgctcttcttctagactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtaagtattagagacagaaaaagtatgaagtcccttctgtgaggactaacaatagtgatgccattttacaaccttgatgactgtgttctcaagaaacaaagcaaatgtcaaccccgtccatagcttcaacagagcataacagctctaaccgcaacagagcctaacggccctaaccacatctgtccccagttggaaagtgtccaaacagttccaactagccagcacttccccaacccctccccaacagaaactttattataaaagcctcagcttgtaagcgatcaggatctcagccagattcctaactggaactcttcgcaggcttttcctgtaaataaacctgtttggccgtggaattgcctcctgttactcgctctctacgtttatatcttcctaacaccttccggctctaatgttttgggtctcgatgaccatctaactcctaaatgctgggggccgctccccatagaaatgcctcgccggatttctccgcctcgcacccagtgggactgggatttttggccccggggtttgcaataagggagtcaccaagcagcagccacctctggaattcctagaaaggaaagagttgcctggcttcagccagtgggctcagaacggctgacgcatttccggcctttgcggttgatcggtcattggggtgctgcagccccgccacctgttccgtagcttgccggtgccccgaaggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttnctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtac

SEQ ID NO: 304243 - DNA, 3266 bp, Homo sapiens
  misc_feature (2040)..(2040): n is a, c, g, or t
tcgatttacaagcacttattttattttacttcatttcacatgcacgtctgttttacgcagttacttgtttacacgctcttcttctagactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtaagtattagagacagaaaaagtatgaagtcccttctgtgaggactaacaatagtgatgccattttacaaccttgatgactgtgttctcaagaaacaaagcaaatgtcaaccccgtccatagcttcaacagagcataacagctctaaccgcaacagagcctaacggccctaaccacatctgtccccagttggaaagtgtccaaacagttccaactagccagcacttccccaacccctccccaacagaaactttattataaaagcctcagcttgtaagcgatcaggatctcagccagattcctaactggaactcttcgcaggcttttcctgtaaataaacctgtttggccgtggaattgcctcctgttactcgctctctacgtttatatcttcctaacaccttccggctctaatgttttgggtctcgatgaccatctaactcctaaatgctgggggccgctccccatagaaatgcctcgccggatttctccgcctcgcacccagtgggactgggatttttggccccggggtttgcaataagggagtcaccaagcagcagccacctctggaattcctagaaaggaaagagttgcctggcttcagccagtgggctcagaacggctgacgcatttccggcctttgcggttgatcggtcattggggtgctgcagccccgccacctgttccgtagcttgccggtgccccgaaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttnctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatgtgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgccctaaaaatttggctttgaagtttatttttaaagcgttaaagaatacatacata

SEQ ID NO: 304244 - DNA, 2037 bp, Homo sapiens
tcgatttacaagcacttattttattttacttcatttcacatgcacgtctgttttacgcagttacttgtttacacgctcttcttctagactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtaagtattagagacagaaaaagtatgaagtcccttctgtgaggactaacaatagtgatgccattttacaaccttgatgactgtgttctcaagaaacaaagcaaatgtcaaccccgtccatagcttcaacagagcataacagctctaaccgcaacagagcctaacggccctaaccacatctgtccccagttggaaagtgtccaaacagttccaactagccagcacttccccaacccctccccaacagaaactttattataaaagcctcagcttgtaagcgatcaggatctcagccagattcctaactggaactcttcgcaggcttttcctgtaaataaacctgtttggccgtggaattgcctcctgttactcgctctctacgtttatatcttcctaacaccttccggctctaatgttttgggtctcgatgaccatctaactcctaaatgctgggggccgctccccatagaaatgcctcgccggatttctccgcctcgcacccagtgggactgggatttttggccccggggtttgcaataagggagtcaccaagcagcagccacctctggaattcctagaaaggaaagagttgcctggcttcagccagtgggctcagaacggctgacgcatttccggcctttgcggttgatcggtcattggggtgctgcagccccgccacctgttccgtagcttgccggtgccccgaaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaatcaaaacctgaatcagaatatttcaaaagagaggaaataaaagttcagcttaaaactgttctgccctaaaaatttggctttgaagtttatttttaaagcgttaaagaatacatacata

SEQ ID NO: 304245 - DNA, 1809 bp, Homo sapiens
tcgatttacaagcacttattttattttacttcatttcacatgcacgtctgttttacgcagttacttgtttacacgctcttcttctagactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtaagtattagagacagaaaaagtatgaagtcccttctgtgaggactaacaatagtgatgccattttacaaccttgatgactgtgttctcaagaaacaaagcaaatgtcaaccccgtccatagcttcaacagagcataacagctctaaccgcaacagagcctaacggccctaaccacatctgtccccagttggaaagtgtccaaacagttccaactagccagcacttccccaacccctccccaacagaaactttattataaaagcctcagcttgtaagcgatcaggatctcagccagattcctaactggaactcttcgcaggcttttcctgtaaataaacctgtttggccgtggaattgcctcctgttactcgctctctacgtttatatcttcctaacaccttccggctctaatgttttgggtctcgatgaccatctaactcctaaatgctgggggccgctccccatagaaatgcctcgccggatttctccgcctcgcacccagtgggactgggatttttggccccggggtttgcaataagggagtcaccaagcagcagccacctctggaattcctagaaaggaaagagttgcctggcttcagccagtgggctcagaacggctgacgcatttccggcctttgcggttgatcggtcattggggtgctgcagccccgccacctgttccgtagcttgccggtgccccgaaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactgtcaaaacctgaatcagaatatttcaaaagagaggaaataaaagttcagcttaaaactgttctgccctaaaaatttggctttgaagtttatttttaaagcgttaaagaatacatacata

SEQ ID NO: 304246 - DNA, 2051 bp, Homo sapiens
tcgatttacaagcacttattttattttacttcatttcacatgcacgtctgttttacgcagttacttgtttacacgctcttcttctagactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtaagtattagagacagaaaaagtatgaagtcccttctgtgaggactaacaatagtgatgccattttacaaccttgatgactgtgttctcaagaaacaaagcaaatgtcaaccccgtccatagcttcaacagagcataacagctctaaccgcaacagagcctaacggccctaaccacatctgtccccagttggaaagtgtccaaacagttccaactagccagcacttccccaacccctccccaacagaaactttattataaaagcctcagcttgtaagcgatcaggatctcagccagattcctaactggaactcttcgcaggcttttcctgtaaataaacctgtttggccgtggaattgcctcctgttactcgctctctacgtttatatcttcctaacaccttccggctctaatgttttgggtctcgatgaccatctaactcctaaatgctgggggccgctccccatagaaatgcctcgccggatttctccgcctcgcacccagtgggactgggatttttggccccggggtttgcaataagggagtcaccaagcagcagccacctctggaattcctagaaaggaaagagttgcctggcttcagccagtgggctcagaacggctgacgcatttccggcctttgcggttgatcggtcattggggtgctgcagccccgccacctgttccgtagcttgccggtgccccgaaggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaattcaaaacctgaatcagaatatttcaaaagagaggaaataaaagttcagcttaaaactgttctgccctaaaaatttggctttgaagtttatttttaaagcgttaaagaatacatacata

SEQ ID NO: 304247 - DNA, 250 bp, Homo sapiens
gacttgtgcccagagagagagagaaaaactgctgaccctgtaagagagaactggccatcttgcagacagacagaggtgagccaggaattaacaagcatgccaaggagtacagctgtaagtgtgggagcggcaggagccacagagccgtttgctgagaagggctgcggtcggaggaggcagccgagacagaggcagacagtgtgagagctgcagcagctgctgctgaataaaatcatattttacctgccta

SEQ ID NO: 304248 - DNA, 808 bp, Homo sapiens
ccctccccaacagaaactttattataaaagcctcagcttgtaagcgatcaggatctcagccagattcctaactggaactcttcgcaggcttttcctgtaaataaacctgtttggccgtggaattgcctcctgttactcgctctctacgtttatatcttcctaacaccttccggctctaatgttttgggtctcgatgaccatctaactcctaaatgctgggggccgctccccatagaaatgcctcgccggatttctccgcctcgcacccagtgggactgggatttttggccccggggtttgcaataagggagtcaccaagcagcagccacctctggaattcctagaaaggaaagagttgcctggcttcagccagtgggctcagaacggctgacgcatttccggcctttgcggttgatcggtcattggggtgctgcagccccgccacctgttccgtagcttgccggtgccccgaaggtgagtcttggccccttgtcgcgacccgccaggttcccagaagatttcaggtctgtgccttggagtaggcggggagggaacgtctgcgcaggcgtgacccccgcccctacacattcactggcctgaagcccccgtggagtaggtggaggtcccgccccttatcctgaagattaaacagcctttctttgtctgagataacgcccggagttctttgtcctgcctccaagacgataaaggagcgcagacacaaaggtgaggttagagcgaaagtttaataagcgaaaggaaaaagctctctgccagcagagaaggggtcccgaccgggagtacccat

SEQ ID NO: 304249 - DNA, 2424 bp, Homo sapiens
cagcaggggaagtgtgtacactatgtgcactgagggtgacacttctgagtgtgggggccctggctagggagtgggactggcaggcttgggtggggttcccaagctttaatcttcctaccccacagaatgttttctctgcccttcaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgccccta

SEQ ID NO: 304250 - DNA, 2086 bp, Homo sapiens
ggacagagcgacgcggaaccccgggcgcctgggtccccagcatgatcctcggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgccccta

SEQ ID NO: 304251 - DNA, 1085 bp, Homo sapiens
ggagttcccctcccacaagctccccacccccactgccagcctcgccatgacccggaaactggatcagctgctggagcaagaatgggagcgctagagtttcccctgtacagaggccagaacccagcactgaggcctagggctgttgcatctttaatcaagccatgaattatagagcagcctacatccctgtttcttccctctccggttctgatgtttctatttcccttttgccatgcctgtgtttatctctccagacctttcctcaccctgcctctgccccttcctagggctctttcgtgtacttcctgggggctgggcaagactccagggaaggggctgtcctggcaggaagcccagactggctggcaggccactgaggggtatatccttgttgcatgcctctccccctggctgggctggctgccagcttcaccctgaaggtaggctggtgaggctggaccccttggccattcccagctaatggagaatgagccaagcattggagtttcacacccagcctgcggcagctggaccacatctggctctggaccagggcatgagagcatgcatgttgtaacagggtggggactcctggtcccttgccctccaggaaatggggggggtctcttccacatgaagagtcttctccaagagccatctagggtgatccccatgtttctcccccaacaacagtttccatggagaatggactggggccagccccaggatccccagagaaacagcgggcatcaagatatgatggcagcagtacggagtgttgttcaaggaataaccaaagagtaaaggatgttgagcaagaagcgtagattctaatgtatagactagaagataagcagatattagatagaacattacaagtgggaagcaccatgatttggacaagaatgtgtgataccctggacctctcttaataccattcacgagatcagcggtggatacaaccgtgtgaagagataactgtcattacacaaggtatatactagataagtctcaattctaagacataacgaggcagtgacagaatgatacagccaaatgtatctggtcgagaatcaagatctcac

SEQ ID NO: 304252 - DNA, 357 bp, Homo sapiens
taaggaaaaaaactttattccttttttcctaggaacttgtcaggatactttagtgaccattccctcactataactctcacccagacccacctaactgatgcataagaagagccactagctgatgtggcccacagctcagactgagccagcatggcttgtgcaggggtaggtagcacagcatcatccagacactgcctcccctggtagcttccattacatcatggcctacactggtcttccccttcccatcaactctttctgcttgacaatgtagcaacccaggccccccacccacggtcctcccctttttcctctccctgacaataaagtctgaatttgttctgccctccgccccta

SEQ ID NO: 304253 - DNA, 2277 bp, Homo sapiens
ggccgggccgcacagccccgagccgcccgggcaacgagcgccgcgtccctggcctgcccggcccggccaggcgcggccccccagcccgggtccgccaccccgggccatggagccgcggcccccagggtctcgcaggatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgccccta

SEQ ID NO: 304254 - DNA, 2329 bp, Homo sapiens
ggacagagcgacgcggaaccccgggcgcctgggtccccagcatgatcctcggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgccccta

SEQ ID NO: 304255 - DNA, 2308 bp, Homo sapiens
cagaactggacctgtagctgagcattcctggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgccccta

SEQ ID NO: 304256 - DNA, 2328 bp, Homo sapiens
cagcaggggaagtgtgtacactatgtgcactgagggtgacacttctgagtgcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgccccta

SEQ ID NO: 304257 - DNA, 2376 bp, Homo sapiens
agagggcagaaccaagggaaggggacgctgtcaggcccaggcccctggggggcaggggcaggccactgcctgggggcagcaggcatcagaaactaaaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgccccta

SEQ ID NO: 304258 - DNA, 2560 bp, Homo sapiens
ggagttcccctcccacaagctccccacccccactgccagcctcgccatgacccggaaactggatcagctgctggagcaagaatgggagcgctagagtttcccctgtacagaggccagaacccagcactgaggcctagggctgttgcatctttaatcaagccatgaattatagagcagcctacatccctgtttcttccctctccggttctgatgtttctatttcccttttgccatgcctgtgtttatctctccagacctttcctcaccctgcctctgccccttcctagggctctttcgtgtacttcctgggggctgggcaagactccagggaaggggctgtcctggcaggaagcccagactggctggcaggccactgaggggtatatccttgttgcatgcctctccccctggctgggctggctgccagcttcaccctgaaggtaggctggtgaggctggaccccttggccattcccagctaatggagaatgagccaagcattggagtttcacacccagcctgcggcagctggaccacatctggctctggaccagggcatgagagcatgcatgttgtaacagggtggggactcctggtcccttgccctccaggaaatggggggggtctcttccacatgaagagtcttctccaagagccatctagggtgatccccatgtttctcccccaacaacagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgccccta

SEQ ID NO: 304259 - DNA, 2562 bp, Homo sapiens
cagcaggggaagtgtgtacactatgtgcactgagggtgacacttctgagtgtgggggccctggctagggagtgggactggcaggcttgggtggggttcccaagctttaatcttcctaccccacagaatgttttctctgcccttcaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagagtctcactctgtcgcccaggctagagtgcagtggcacaatctcagctcactgcaacctccacctcccaggttcaagcgattctcctgcctcagcctcctgagtagctgggattacaggcacctgccaccacacccggtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgccccta

SEQ ID NO: 304260 - DNA, 3101 bp, Homo sapiens
cagcaggggaagtgtgtacactatgtgcactgagggtgacacttctgagtgtgggggccctggctagggagtgggactggcaggcttgggtggggttcccaagctttaatcttcctaccccacagaatgttttctctgcccttcaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgcccctaaaaaaaaaaaaaaacaaacaaaaaaaaaaaaaaaaaaacaaaaaagagaaaacgaaacaagaagagagcagccaagacgaaagagagacagaagagacaaaaaaatagggggagggggcgggaggaagagagagcccccggggggagaagaagaggggcgggcggagcgaaggagagagagaggaaaggaagggcgcggcagaccacgcgacgcgagggccggcgaaacgaagcgaagagagagaccgcagccgcgacgcagcagcggagacaaggagccagccgcacgagagcgacgggaacgacaggcgcacgaagcggagggagaagaaggcggccagggggccccacacgaccccaaccgcacgaagcgagccgaggaaggcgagaacggcaagcgggggagaggacacgaaaaacgcaacaaacagaaagaccacgaaaggcccccaaggaccacaaaggggcagggacgcgagcccaggcaagcagagaggcaagaggagcagtgaggaggagagagagagaaaaggagaggacaggacgaaaggagcgaaaacagggcaacggagcagcgagcgcgagggagagagaacggaaaaggaggagaaggcggacgacaagaagcagcaagcagagaaagagagtaggccaacgcagcgcctcctaccccccgg

SEQ ID NO: 304261 - DNA, 2373 bp, Homo sapiens
cagcaggggaagtgtgtacactatgtgcactgagggtgacacttctgagtgtgggggccctggctagggagtgggactggcaggcttgggtggggttcccaagctttaatcttcctaccccacagaatgttttctctgcccttcaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgccccta

SEQ ID NO: 304262 - DNA, 234 bp, Homo sapiens
ctaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacaggtgggtctaaggcccttcccaggaattctgggacgctccacccgctaagtggggaaggggagcaagg

SEQ ID NO: 304263 - DNA, 1066 bp, Homo sapiens
ggagtcgggttacaccacttgtgtctgagttcacgcagcatgttcctctgtcagggattccgcaaatatctccctgaggtaaaaaaggaaagtgtgctgcgctccagcacccagagcagtgagcccagtcccgagtcccggagagagctccagcaataggggccatgtcgccatagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgctcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattca

SEQ ID NO: 304264 - DNA, 4167 bp, Homo sapiens
  misc_feature (3169)..(3169): n is a, c, g, or t
  misc_feature (3194)..(3194): n is a, c, g, or t
  misc_feature (3224)..(3224): n is a, c, g, or t
  misc_feature (3248)..(3248): n is a, c, g, or t
  misc_feature (3384)..(3384): n is a, c, g, or t
ggagtcgggttacaccacttgtgtctgagttcacgcagcatgttcctctgtcagggattccgcaaatatctccctgaggtaaaaaaggaaagtgtgctgcgctccagcacccagagcagtgagcccagtcccgagtcccggagagagctccagcaataggggccatgtcgccatagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgctcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttatggaatgtgtgcaaaccacacacttaagcaagctctggggaatgagagttggggggaatcaactgttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagctgttccagccacctttttctaacggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatctaccactgtcagcaaaaacatgaacttagccctcaacagaatatttcacttcattctagtgtcacctctgcgtcacctgcactggagtcaccacttgcctgttgggtaagaccaggatgcaccactgaaataaaaaggggtcagacaatacaagaaaagccagtagaaattgccaaatgtatcagaatacacacaggctttctaaggatatggcccaagaggaaggctctagagcccaccctgaaacaggatttttgacttcacagataaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaagcaattaacgctggcatctgataacaacgaaaagtatggagtctggagaatcgctagactctaaaaattataaaggtttagacttgggctttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtgncttctccataggcagaaaactagcntagtttttttattagaaattgttattcaanaatagtacatgttacaaataaatnccattttaaactgaaaaaattgtagactttcaaatcagttagggtggtcaccctaaaaaagggcattttttccccttagtctccttgttcatgttgctcacaacaagaaatgggctaatgctatgaataataatancaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatataaagatatgtttatagcaattgtatatacgtagagagataatatgtagtatgaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttcta

SEQ ID NO: 304265 - DNA, 1295 bp, Homo sapiens
ctggagagtgcgcgcaccgccgcccgggcagccgctggctccagctcacgaaacagccccgggcgccgcgccgctccgagtccagcctcctactgagaacagtccctccctcgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgctcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattca

SEQ ID NO: 304266 - DNA, 1390 bp, Homo sapiens
ctggagagtgcgcgcaccgccgcccgggcagccgctggctccagctcacgaaacagccccgggcgccgcgccgctccgagtccagcctcctactgagaacagtccctccctcgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcagaaatgaatttccatcttttctgaacataaaaaaaagaagaattctaagaagttgactgaagcatctgggtgctttttcttgggctccttctgcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgctcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattca

SEQ ID NO: 304267 - DNA, 4519 bp, Homo sapiens
  misc_feature (3429)..(3429): n is a, c, g, or t
  misc_feature (3454)..(3454): n is a, c, g, or t
  misc_feature (3484)..(3484): n is a, c, g, or t
  misc_feature (3508)..(3508): n is a, c, g, or t
  misc_feature (3644)..(3644): n is a, c, g, or t
ggagtcgggttacaccacttgtgtctgagttcacgcagcatgttcctctgtcagggattccgcaaatatctccctgaggtaaaaaaggaaagtgtgctgcgctccagcacccagagcagtgagcccagtcccgagtcccggagagagctccagcaataggggccatgtcgccatagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgctcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaatccttcaactgacagcttaaagaacttcaggttgttctgattcttgagcctcctctacagcttcagagaggactttcattttattttggatcaaatgctccacaactagttgaaactggaattaaattttatatgaagttcctagatgatttaaagctgtaagaagaagaataatgaatcataagaaaacttgctgctacagacatcaaaaaggaatgttaccatccctcatgctaatccttttcattttaaataaacaggatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttatggaatgtgtgcaaaccacacacttaagcaagctctggggaatgagagttggggggaatcaactgttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagctgttccagccacctttttctaacggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatctaccactgtcagcaaaaacatgaacttagccctcaacagaatatttcacttcattctagtgtcacctctgcgtcacctgcactggagtcaccacttgcctgttgggtaagaccaggatgcaccactgaaataaaaaggggtcagacaatacaagaaaagccagtagaaattgccaaatgtatcagaatacacacaggctttctaaggatatggcccaagaggaaggctctagagcccaccctgaaacaggatttttgacttcacagataaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaagcaattaacgctggcatctgataacaacgaaaagtatggagtctggagaatcgctagactctaaaaattataaaggtttagacttgggctttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtgncttctccataggcagaaaactagcntagtttttttattagaaattgttattcaanaatagtacatgttacaaataaatnccattttaaactgaaaaaattgtagactttcaaatcagttagggtggtcaccctaaaaaagggcattttttccccttagtctccttgttcatgttgctcacaacaagaaatgggctaatgctatgaataataatancaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatataaagatatgtttatagcaattgtatatacgtagagagataatatgtagtatgaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttact

SEQ ID NO: 304268 - DNA, 1675 bp, Homo sapiens
  misc_feature (1537)..(1537): n is a, c, g, or t
  misc_feature (1541)..(1541): n is a, c, g, or t
ggagtcgggttacaccacttgtgtctgagttcacgcagcatgttcctctgtcagggattccgcaaatatctccctgaggtaaaaaaggaaagtgtgctgcgctccagcacccagagcagtgagcccagtcccgagtcccggagagagctccagcaataggggccatgtcgccatagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgctcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagatacctcnaagngagggtggtccactgggcagtctgcaggcgcctttgggccccaggttttgggggggcccccctccctcgggagggggggaccgctttctgggtcccagagtccccggggcaccaggggggtttttttccccccg

SEQ ID NO: 304269 - DNA, 1326 bp, Homo sapiens
ggagtcgggttacaccacttgtgtctgagttcacgcagcatgttcctctgtcagggattccgcaaatatctccctgaggtaaaaaaggaaagtgtgctgcgctccagcacccagagcagtgagcccagtcccgagtcccggagagagctccagcaataggggccatgtcgccatagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgctcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaatccttcaactgacagcttaaagaacttcaggttgttctgattcttgagcctcctctacagcttcagagaggactttcattttattttggatcaaatgctccacaactagttgaaactggaattaaattttatatgaagttcctagatgatttaaagctgtaagaagaagaataatgaatcataagaaaacttgctgctacagacatcaaaaaggaatgttaccatccctcatgctaatccttttcattttaaataaacaggatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattca

SEQ ID NO: 304270 - DNA, 730 bp, Homo sapiens
ggagtcgggttacaccacttgtgtctgagttcacgcagcatgttcctctgtcagggattccgcaaatatctccctgaggtaaaaaaggaaagtgtgctgcgctccagcacccagagcagtgagcccagtcccgagtcccggagagagctccagcaataggggccatgtcgccatagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgctcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctccaggttccactccttctctgcttccaccagagctggtctgacc

SEQ ID NO: 304271 - DNA, 1873 bp, Homo sapiens
  misc_feature (783)..(783): n is a, c, g, or t
  misc_feature (808)..(808): n is a, c, g, or t
  misc_feature (838)..(838): n is a, c, g, or t
  misc_feature (862)..(862): n is a, c, g, or t
  misc_feature (998)..(998): n is a, c, g, or t
cctttaaaaaataacatcagggatgaccctttcaagacattaagtaaatccaaaagggccaatattatatgaatcccttgatgtgaggtacctagactagtgaaattcataaagacaaagtagaacaaagattacgttttgtcacagggggcaggagggaatgggaatttattgtttaaggggcacagagattagtgtgggatcatgaaaaagttccggaggtgcatagtggtgactggtacatacaacgaatgtatttaatgcctttaaactgtaacttcaaaatggttaaaatttaaatcttacgaacattttgccacagtaaatttgaaaaataactattccattaatttaacaatactcaagaatgaagaaagccaatgatggtgggggaaaaaaagtttaggttcataaactgtcttaaatctgtatacaaggctaaacaaataagaaatgaagacaaaaacccaacctttcaaatctaaagaaaataatctgttttaaagacacagatgaagatcaggaacccaaaacagaagaaaggaaaagcaattaacgctggcatctgataacaacgaaaagtatggagtctggagaatcgctagactctaaaaattataaaggtttagacttgggctttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtgncttctccataggcagaaaactagcntagtttttttattagaaattgttattcaanaatagtacatgttacaaataaatnccattttaaactgaaaaaattgtagactttcaaatcagttagggtggtcaccctaaaaaagggcattttttccccttagtctccttgttcatgttgctcacaacaagaaatgggctaatgctatgaataataatancaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatataaagatatgtttatagcaattgtatatacgtagagagataatatgtagtatgaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttact

SEQ ID NO: 304272 - DNA, 594 bp, Homo sapiens
tcttttcttcttttttctttttccagtttttccaacttcccctttccctgcatcagactttcttttatcccagaatacagcaatagcctttatatctataatcttaaaatcctttctttcctcaagtctgtatattatctgcagcagtaattcttcatttctttcatttctctcagttttcttacatcatcgccaatgaattagccaagatgttctcctgtgctcttttggtgaaattttcagaacaaaacaagaaaaaggagatccctttggtacattagaatcctggaacttctttcttctctctctttctttctctctctcgtttccttgtagacagaatatagatttttgtttctttcttataatgggcctgttcaccttcaccctgtcttcaaattttttctttctctttagcagaaatgaatttccatcttttctgaacataaaaaaaagaagaattctaagaagttgactgaagcatctgggtgctttttcttgggctccttctggcaagttggcagaacgaaggaaagaaggcagggaaggagggagagaggagggaggggaggaaggaaggaagggagggaggga

SEQ ID NO: 304273 - DNA, 989 bp, Homo sapiens
ggagtcgggttacaccacttgtgtctgagttcacgcagcatgttcctctgtcagggattccgcaaatatctccctgaggtaaaaaaggaaagtgtgctgcgctccagcacccagagcagtgagcccagtcccgagtcccggagagagctccagcaataggggccatgtcgccatagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgctcatctacttcctggaggagcgcatgcaacagaagtatgaggccagccgggaggacatctacaagcggggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattca

SEQ ID NO: 304274 - DNA, 1206 bp, Homo sapiens
ggagtcgggttacaccacttgtgtctgagttcacgcagcatgttcctctgtcagggattccgcaaatatctccctgaggtaaaaaaggaaagtgtgctgcgctccagcacccagagcagtgagcccagtcccgagtcccggagagagctccagcaataggggccatgtcgccatagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgctcatctacttcctggaggagcgcatgcaacagaagtatgaggccagccgggaggacatctacaagcggaacactgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatgcagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaaatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgcagtcaaacctgtaagtcaaaggatatgaaataatagtaactatacattaagcacagaagaaaatgaaacaaacaaaaaggttttaaaccaaccaaaaatatgtcttattttggatgttctatatgttcttacattctctcaggtcttttgtgtcattatgaacacaattctaacaagcttgattattttatttccattcacatattacaggcaagctgaaaaa

SEQ ID NO: 304275 - DNA, 953 bp, Homo sapiens
aaccgaggaggtggaggttgcagtgagccgagatcacaccactgcactccagcctggtgacagagcgagactccgtctcaaaaaaaaaaaaaaaaaaagaaattagtggggcatggtggtgtacgcttatggtcccagctacttgggatgctgaggtgggaggatcacttggacccaggagttagaggttgcagtgggctgtgatcactgcacttcagcctgggcgaaagaacaagatggacgctgtctcaaaaaataaacttttatgaacatggttgtacatgtgtctatatgccttaggttactgttcctaagagaagttataaaatgagaaattaataaaaggattgctgggaggacatgcaccttttaaattttgatattactgccaaaattgcccttcaagagtttgatagtatttttccatatttttctttttaatttttgctaatttcgtagacaaaagatagtctcttgttaaaatttgtatttctttattagtgaggttgaatgtctttttatgttaattgaccatttgaatttcttgtatgacttttgactcttcatatgctttcttcattgtttcttttctctttggtttgttgaagtttttttgcacattcccttaagtttggcagtctaatctgtatctttggcataaatattttaaaacaaaaaatgctggccaagtgtggtggctcaggcctataatcccagaacttgggaggctgaggtgggagtattgcttgagctcaggagtttgagaccagtcggggcaatatagtgggacctcatctccacaaaaagaagaaacagccaaaaaaaaaaaaaaaaaaaaaagtactaccagtatttatctaagggcagaagaccagtaatggcttttaagagtccattttgtcattgtctccctagttaattacaggtgggggatcttttgcctctggtctctt

SEQ ID NO: 304276 - DNA, 3526 bp, Homo sapiens
acggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaggcattacactcgaagagtttgacagattatcttttgatatgattttaatgagccctccctgccagccattcacaaggattggccggcagggtgatatgactgattcaaggacgaatagcttcttacatattctagatattctcccaagattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatcaaatttatattactgtattttataaaatacgaactattgttatgctttatggagagtatattttcatatgaaactgataaatatatatgtggaatattctttttaaaaacaattttataaacaaatcaaggagcactagagctttagtgtctacatgagtatcttgtgaagtgtcataacaggcataacatatttttatgttaattaaagaagttttttatttctaattttaaaataatgattctaattctagcccattgaatgttttacttaatttccaatcctgtaaatatttctttatttcatctaaacaaatgcatatgatatgtaaaccaaattatcatcattcagtttatacagcagactgaagaatatgtcaggaaaaataatcctaaatgtttgattacctctccatgaagcggccacagaaactgttggtgcacattatctacattttcctcagcctctatctgaaggacaaaactcatttttccttcttcattttgtatgtactttcctttagttgactattatcaaagcttgtttttgtcttctcagcttctgagttgaatttgcctttgcacgctgaggaatgtagcatgacgttaagatttcagggaggaagctgccctctgatcccatgtcatatgacagtactcccctccccccagttgttctttattgtagcaacatacactctcaatgaacttttatgacttttaactttctctgtctctcttcctcagcagacctcttggaattagggtttctaatcaaactaagtcttgcatcataaattctatggtttgtgataaaagcaagtgacaaagagaagagagatgaaaagaaacaagtccagaaatcatattacaagattttaattcaaatttttcttcttaaaaatcagctatttagaggtggataaattggaagtttgtgcattgcttgtgggaacgtaaaatggttcagctgctgttggaaaacgctatggaggttcgtcacaaaattcaacatagaattaccctatgattcagcgattccacctctggctatagatccaaaagaattgaaagcagggacttgaacagatatttgtacaccagtgtttataacaccattatttacagtagccaaaaggtagaagcagcccaagtgtcatcccattcacccatgaatggatgcaggaattgtgttccgtgcatgcagtggaatagtaccagccttccgcaggaaggaaattctgacatatgcggtgacatggatgaaccttgagtacattatgcgaagtgaaataagccaccctgtggggatggagaatgggtagttagtgcataatggatacaaagtttctgattggggtgatgagaaagttctggaggtggatggggaggatggttgcacaacagtgtgagtgtacttaatgccactgcaactgtatatttaaaaatagttaaaatgataaattttacattatgtatattttactgcaattgaaaaaatcatactctattaccaatttttcagaactcatagataaatatgaatgtagggaagctgtaagccagcccatatacagaaactatcactatctacatttttcatatgtgttcagacagagcctattacaagtctcataaatttcagtaaacaatcacaaattattttggcacactttcatgtaggttctgttcactgctgaaatattctaaataaaatggtttagagttttactgtaactatgaataattatgctataattatagtatcccacattcggttgagcaacattatacaaaataagtgtcgagttactgtgcaccaactataaatacttgaaaggtctgtagagacatttgcttacaaactggtagacagaatgtagcttagtggaattcttaaattatgggaatgtattcacaggaagacggtgattcttgcccttaattcataattgaaaatatgcagtaacaagcataaaactcacatcttaatgaagatgtatctaccagtgtcattcaattagcagatgtatatgtatgcataattaatttggaaaatgttattttatggaatgtctgctatatgcttttggtaataatgctgtatataaaatttgcactggaaattctgtttcctgat

SEQ ID NO: 304277 - DNA, 1435 bp, Homo sapiens
acggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaggcattacactcgaagagtttgacagattatcttttgatatgattttaatgagccctccctgccagccattcacaaggattggccggcagggtgatatgactgattcaaggacgaatagcttcttacatattctagatattctcccaagattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatcaaatttatattactgtattttataaaatacgaactattgttatgcttt

SEQ ID NO: 304278 - DNA, 363 bp, Homo sapiens
gaaacttccctgcttccttatttaggaccaagagtaacaagagtaactaaagctgtatacctgcacaagtggtggctgccattgatgtcaacactgtcgctaatgaagtatacaagtataattttcctcacacacagttacttgccaagacgattgaattacatactgtagagtaaatgatagctaccgaagacagagtgatccgtgataaatatcattaatgcctctgaagaggagaatgactccagtggaacaaaaactcttaataaaaatagataaaaatttttctagaatgaaatttacaatataacatccatgagcccttctggaacagatgactgcatcacttaatctagctgagca

SEQ ID NO: 304279 - DNA, 3454 bp, Homo sapiens
acggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaggcattacactcgaagagtttgacagattatcttttgatatgattttaatgagccctccctgccagccattcacaagattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatcaaatttatattactgtattttataaaatacgaactattgttatgctttatggagagtatattttcatatgaaactgataaatatatatgtggaatattctttttaaaaacaattttataaacaaatcaaggagcactagagctttagtgtctacatgagtatcttgtgaagtgtcataacaggcataacatatttttatgttaattaaagaagttttttatttctaattttaaaataatgattctaattctagcccattgaatgttttacttaatttccaatcctgtaaatatttctttatttcatctaaacaaatgcatatgatatgtaaaccaaattatcatcattcagtttatacagcagactgaagaatatgtcaggaaaaataatcctaaatgtttgattacctctccatgaagcggccacagaaactgttggtgcacattatctacattttcctcagcctctatctgaaggacaaaactcatttttccttcttcattttgtatgtactttcctttagttgactattatcaaagcttgtttttgtcttctcagcttctgagttgaatttgcctttgcacgctgaggaatgtagcatgacgttaagatttcagggaggaagctgccctctgatcccatgtcatatgacagtactcccctccccccagttgttctttattgtagcaacatacactctcaatgaacttttatgacttttaactttctctgtctctcttcctcagcagacctcttggaattagggtttctaatcaaactaagtcttgcatcataaattctatggtttgtgataaaagcaagtgacaaagagaagagagatgaaaagaaacaagtccagaaatcatattacaagattttaattcaaatttttcttcttaaaaatcagctatttagaggtggataaattggaagtttgtgcattgcttgtgggaacgtaaaatggttcagctgctgttggaaaacgctatggaggttcgtcacaaaattcaacatagaattaccctatgattcagcgattccacctctggctatagatccaaaagaattgaaagcagggacttgaacagatatttgtacaccagtgtttataacaccattatttacagtagccaaaaggtagaagcagcccaagtgtcatcccattcacccatgaatggatgcaggaattgtgttccgtgcatgcagtggaatagtaccagccttccgcaggaaggaaattctgacatatgcggtgacatggatgaaccttgagtacattatgcgaagtgaaataagccaccctgtggggatggagaatgggtagttagtgcataatggatacaaagtttctgattggggtgatgagaaagttctggaggtggatggggaggatggttgcacaacagtgtgagtgtacttaatgccactgcaactgtatatttaaaaatagttaaaatgataaattttacattatgtatattttactgcaattgaaaaaatcatactctattaccaatttttcagaactcatagataaatatgaatgtagggaagctgtaagccagcccatatacagaaactatcactatctacatttttcatatgtgttcagacagagcctattacaagtctcataaatttcagtaaacaatcacaaattattttggcacactttcatgtaggttctgttcactgctgaaatattctaaataaaatggtttagagttttactgtaactatgaataattatgctataattatagtatcccacattcggttgagcaacattatacaaaataagtgtcgagttactgtgcaccaactataaatacttgaaaggtctgtagagacatttgcttacaaactggtagacagaatgtagcttagtggaattcttaaattatgggaatgtattcacaggaagacggtgattcttgcccttaattcataattgaaaatatgcagtaacaagcataaaactcacatcttaatgaagatgtatctaccagtgtcattcaattagcagatgtatatgtatgcataattaatttggaaaatgttattttatggaatgtctgctatatgcttttggtaataatgctgtatataaaatttgcactggaaattctgtttcctgat

SEQ ID NO: 304280 - DNA, 3388 bp, Homo sapiens
acggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaggcattacactcgaagagtttgacagattatcttttgatatgattttaatgagccctccctgccagccattcacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatcaaatttatattactgtattttataaaatacgaactattgttatgctttatggagagtatattttcatatgaaactgataaatatatatgtggaatattctttttaaaaacaattttataaacaaatcaaggagcactagagctttagtgtctacatgagtatcttgtgaagtgtcataacaggcataacatatttttatgttaattaaagaagttttttatttctaattttaaaataatgattctaattctagcccattgaatgttttacttaatttccaatcctgtaaatatttctttatttcatctaaacaaatgcatatgatatgtaaaccaaattatcatcattcagtttatacagcagactgaagaatatgtcaggaaaaataatcctaaatgtttgattacctctccatgaagcggccacagaaactgttggtgcacattatctacattttcctcagcctctatctgaaggacaaaactcatttttccttcttcattttgtatgtactttcctttagttgactattatcaaagcttgtttttgtcttctcagcttctgagttgaatttgcctttgcacgctgaggaatgtagcatgacgttaagatttcagggaggaagctgccctctgatcccatgtcatatgacagtactcccctccccccagttgttctttattgtagcaacatacactctcaatgaacttttatgacttttaactttctctgtctctcttcctcagcagacctcttggaattagggtttctaatcaaactaagtcttgcatcataaattctatggtttgtgataaaagcaagtgacaaagagaagagagatgaaaagaaacaagtccagaaatcatattacaagattttaattcaaatttttcttcttaaaaatcagctatttagaggtggataaattggaagtttgtgcattgcttgtgggaacgtaaaatggttcagctgctgttggaaaacgctatggaggttcgtcacaaaattcaacatagaattaccctatgattcagcgattccacctctggctatagatccaaaagaattgaaagcagggacttgaacagatatttgtacaccagtgtttataacaccattatttacagtagccaaaaggtagaagcagcccaagtgtcatcccattcacccatgaatggatgcaggaattgtgttccgtgcatgcagtggaatagtaccagccttccgcaggaaggaaattctgacatatgcggtgacatggatgaaccttgagtacattatgcgaagtgaaataagccaccctgtggggatggagaatgggtagttagtgcataatggatacaaagtttctgattggggtgatgagaaagttctggaggtggatggggaggatggttgcacaacagtgtgagtgtacttaatgccactgcaactgtatatttaaaaatagttaaaatgataaattttacattatgtatattttactgcaattgaaaaaatcatactctattaccaatttttcagaactcatagataaatatgaatgtagggaagctgtaagccagcccatatacagaaactatcactatctacatttttcatatgtgttcagacagagcctattacaagtctcataaatttcagtaaacaatcacaaattattttggcacactttcatgtaggttctgttcactgctgaaatattctaaataaaatggtttagagttttactgtaactatgaataattatgctataattatagtatcccacattcggttgagcaacattatacaaaataagtgtcgagttactgtgcaccaactataaatacttgaaaggtctgtagagacatttgcttacaaactggtagacagaatgtagcttagtggaattcttaaattatgggaatgtattcacaggaagacggtgattcttgcccttaattcataattgaaaatatgcagtaacaagcataaaactcacatcttaatgaagatgtatctaccagtgtcattcaattagcagatgtatatgtatgcataattaatttggaaaatgttattttatggaatgtctgctatatgcttttggtaataatgctgtatataaaatttgcactggaaattctgtttcctgat

SEQ ID NO: 304281 - DNA, 3377 bp, Homo sapiens
acggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatcaaatttatattactgtattttataaaatacgaactattgttatgctttatggagagtatattttcatatgaaactgataaatatatatgtggaatattctttttaaaaacaattttataaacaaatcaaggagcactagagctttagtgtctacatgagtatcttgtgaagtgtcataacaggcataacatatttttatgttaattaaagaagttttttatttctaattttaaaataatgattctaattctagcccattgaatgttttacttaatttccaatcctgtaaatatttctttatttcatctaaacaaatgcatatgatatgtaaaccaaattatcatcattcagtttatacagcagactgaagaatatgtcaggaaaaataatcctaaatgtttgattacctctccatgaagcggccacagaaactgttggtgcacattatctacattttcctcagcctctatctgaaggacaaaactcatttttccttcttcattttgtatgtactttcctttagttgactattatcaaagcttgtttttgtcttctcagcttctgagttgaatttgcctttgcacgctgaggaatgtagcatgacgttaagatttcagggaggaagctgccctctgatcccatgtcatatgacagtactcccctccccccagttgttctttattgtagcaacatacactctcaatgaacttttatgacttttaactttctctgtctctcttcctcagcagacctcttggaattagggtttctaatcaaactaagtcttgcatcataaattctatggtttgtgataaaagcaagtgacaaagagaagagagatgaaaagaaacaagtccagaaatcatattacaagattttaattcaaatttttcttcttaaaaatcagctatttagaggtggataaattggaagtttgtgcattgcttgtgggaacgtaaaatggttcagctgctgttggaaaacgctatggaggttcgtcacaaaattcaacatagaattaccctatgattcagcgattccacctctggctatagatccaaaagaattgaaagcagggacttgaacagatatttgtacaccagtgtttataacaccattatttacagtagccaaaaggtagaagcagcccaagtgtcatcccattcacccatgaatggatgcaggaattgtgttccgtgcatgcagtggaatagtaccagccttccgcaggaaggaaattctgacatatgcggtgacatggatgaaccttgagtacattatgcgaagtgaaataagccaccctgtggggatggagaatgggtagttagtgcataatggatacaaagtttctgattggggtgatgagaaagttctggaggtggatggggaggatggttgcacaacagtgtgagtgtacttaatgccactgcaactgtatatttaaaaatagttaaaatgataaattttacattatgtatattttactgcaattgaaaaaatcatactctattaccaatttttcagaactcatagataaatatgaatgtagggaagctgtaagccagcccatatacagaaactatcactatctacatttttcatatgtgttcagacagagcctattacaagtctcataaatttcagtaaacaatcacaaattattttggcacactttcatgtaggttctgttcactgctgaaatattctaaataaaatggtttagagttttactgtaactatgaataattatgctataattatagtatcccacattcggttgagcaacattatacaaaataagtgtcgagttactgtgcaccaactataaatacttgaaaggtctgtagagacatttgcttacaaactggtagacagaatgtagcttagtggaattcttaaattatgggaatgtattcacaggaagacggtgattcttgcccttaattcataattgaaaatatgcagtaacaagcataaaactcacatcttaatgaagatgtatctaccagtgtcattcaattagcagatgtatatgtatgcataattaatttggaaaatgttattttatggaatgtctgctatatgcttttggtaataatgctgtatataaaatttgcactggaaattctgtttcctgat

SEQ ID NO: 304282 - DNA, 3383 bp, Homo sapiens
acggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaagattggccggcagggtgatatgactgattcaaggacgaatagcttcttacatattctagatattctcccaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatcaaatttatattactgtattttataaaatacgaactattgttatgctttatggagagtatattttcatatgaaactgataaatatatatgtggaatattctttttaaaaacaattttataaacaaatcaaggagcactagagctttagtgtctacatgagtatcttgtgaagtgtcataacaggcataacatatttttatgttaattaaagaagttttttatttctaattttaaaataatgattctaattctagcccattgaatgttttacttaatttccaatcctgtaaatatttctttatttcatctaaacaaatgcatatgatatgtaaaccaaattatcatcattcagtttatacagcagactgaagaatatgtcaggaaaaataatcctaaatgtttgattacctctccatgaagcggccacagaaactgttggtgcacattatctacattttcctcagcctctatctgaaggacaaaactcatttttccttcttcattttgtatgtactttcctttagttgactattatcaaagcttgtttttgtcttctcagcttctgagttgaatttgcctttgcacgctgaggaatgtagcatgacgttaagatttcagggaggaagctgccctctgatcccatgtcatatgacagtactcccctccccccagttgttctttattgtagcaacatacactctcaatgaacttttatgacttttaactttctctgtctctcttcctcagcagacctcttggaattagggtttctaatcaaactaagtcttgcatcataaattctatggtttgtgataaaagcaagtgacaaagagaagagagatgaaaagaaacaagtccagaaatcatattacaagattttaattcaaatttttcttcttaaaaatcagctatttagaggtggataaattggaagtttgtgcattgcttgtgggaacgtaaaatggttcagctgctgttggaaaacgctatggaggttcgtcacaaaattcaacatagaattaccctatgattcagcgattccacctctggctatagatccaaaagaattgaaagcagggacttgaacagatatttgtacaccagtgtttataacaccattatttacagtagccaaaaggtagaagcagcccaagtgtcatcccattcacccatgaatggatgcaggaattgtgttccgtgcatgcagtggaatagtaccagccttccgcaggaaggaaattctgacatatgcggtgacatggatgaaccttgagtacattatgcgaagtgaaataagccaccctgtggggatggagaatgggtagttagtgcataatggatacaaagtttctgattggggtgatgagaaagttctggaggtggatggggaggatggttgcacaacagtgtgagtgtacttaatgccactgcaactgtatatttaaaaatagttaaaatgataaattttacattatgtatattttactgcaattgaaaaaatcatactctattaccaatttttcagaactcatagataaatatgaatgtagggaagctgtaagccagcccatatacagaaactatcactatctacatttttcatatgtgttcagacagagcctattacaagtctcataaatttcagtaaacaatcacaaattattttggcacactttcatgtaggttctgttcactgctgaaatattctaaataaaatggtttagagttttactgtaactatgaataattatgctataattatagtatcccacattcggttgagcaacattatacaaaataagtgtcgagttactgtgcaccaactataaatacttgaaaggtctgtagagacatttgcttacaaactggtagacagaatgtagcttagtggaattcttaaattatgggaatgtattcacaggaagacggtgattcttgcccttaattcataattgaaaatatgcagtaacaagcataaaactcacatcttaatgaagatgtatctaccagtgtcattcaattagcagatgtatatgtatgcataattaatttggaaaatgttattttatggaatgtctgctatatgcttttggtaataatgctgtatataaaatttgcactggaaattctgtttcctgat

SEQ ID NO: 304283 - DNA, 3311 bp, Homo sapiens
acggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcggatttcctgagaagataacagtgaaacagcgttatcgcctacttggaaatagtctcaacgtgcatgtagtagctaaactaatcaaaatcttatatgaataattttgaaataactctgaaagatggtcatatgatattccttcattttcagagagtaattctgaaattctgttttgaactaattctggtgaaatttaactaaattattttaatctgtccttattaagaaatttggattttattaaaaaaatccatgtgtttcatcaaatttatattactgtattttataaaatacgaactattgttatgctttatggagagtatattttcatatgaaactgataaatatatatgtggaatattctttttaaaaacaattttataaacaaatcaaggagcactagagctttagtgtctacatgagtatcttgtgaagtgtcataacaggcataacatatttttatgttaattaaagaagttttttatttctaattttaaaataatgattctaattctagcccattgaatgttttacttaatttccaatcctgtaaatatttctttatttcatctaaacaaatgcatatgatatgtaaaccaaattatcatcattcagtttatacagcagactgaagaatatgtcaggaaaaataatcctaaatgtttgattacctctccatgaagcggccacagaaactgttggtgcacattatctacattttcctcagcctctatctgaaggacaaaactcatttttccttcttcattttgtatgtactttcctttagttgactattatcaaagcttgtttttgtcttctcagcttctgagttgaatttgcctttgcacgctgaggaatgtagcatgacgttaagatttcagggaggaagctgccctctgatcccatgtcatatgacagtactcccctccccccagttgttctttattgtagcaacatacactctcaatgaacttttatgacttttaactttctctgtctctcttcctcagcagacctcttggaattagggtttctaatcaaactaagtcttgcatcataaattctatggtttgtgataaaagcaagtgacaaagagaagagagatgaaaagaaacaagtccagaaatcatattacaagattttaattcaaatttttcttcttaaaaatcagctatttagaggtggataaattggaagtttgtgcattgcttgtgggaacgtaaaatggttcagctgctgttggaaaacgctatggaggttcgtcacaaaattcaacatagaattaccctatgattcagcgattccacctctggctatagatccaaaagaattgaaagcagggacttgaacagatatttgtacaccagtgtttataacaccattatttacagtagccaaaaggtagaagcagcccaagtgtcatcccattcacccatgaatggatgcaggaattgtgttccgtgcatgcagtggaatagtaccagccttccgcaggaaggaaattctgacatatgcggtgacatggatgaaccttgagtacattatgcgaagtgaaataagccaccctgtggggatggagaatgggtagttagtgcataatggatacaaagtttctgattggggtgatgagaaagttctggaggtggatggggaggatggttgcacaacagtgtgagtgtacttaatgccactgcaactgtatatttaaaaatagttaaaatgataaattttacattatgtatattttactgcaattgaaaaaatcatactctattaccaatttttcagaactcatagataaatatgaatgtagggaagctgtaagccagcccatatacagaaactatcactatctacatttttcatatgtgttcagacagagcctattacaagtctcataaatttcagtaaacaatcacaaattattttggcacactttcatgtaggttctgttcactgctgaaatattctaaataaaatggtttagagttttactgtaactatgaataattatgctataattatagtatcccacattcggttgagcaacattatacaaaataagtgtcgagttactgtgcaccaactataaatacttgaaaggtctgtagagacatttgcttacaaactggtagacagaatgtagcttagtggaattcttaaattatgggaatgtattcacaggaagacggtgattcttgcccttaattcataattgaaaatatgcagtaacaagcataaaactcacatcttaatgaagatgtatctaccagtgtcattcaattagcagatgtatatgtatgcataattaatttggaaaatgttattttatggaatgtctgctatatgcttttggtaataatgctgtatataaaatttgcactggaaattctgtttcctgat

SEQ ID NO: 304284 - DNA, 1810 bp, Homo sapiens
acggaccggcaggcctagctccggggctgcggcggctgaggcgcggggatggagcccctgcgggtgctggagctatacagcggcgtgggcggcatgcaccacgcgctgagagaaagctgtatacctgcacaagtggtggctgccattgatgtcaacactgtcgctaatgaagtatacaagtataattttcctcacacacagttacttgccaagacgattgaaggcattacactcgaagagtttgacagattatcttttgatatgattttaatgagccctccctgccagccattcacaaggattggccggcagggtgatatgactgattcaaggacgaatagcttcttacatattctagatattctcccaagattacaaaaattaccaaagtatattcttttggaaaatgttaaaggttttgaagtatcttctacaagagacctcttgatacaaacaatagaaaattgtggctttcagtaccaagagtttctattatctccaacctctcttggcattccaaattcaaggctacgatattttcttattgcaaagcttcagtcagagccattaccctttcaagcccctggtcaggtactgatggagttccccaaaattgaatctgtacatccacaaaaatatgcaatggatgtagaaaataaaattcaagaaaagaacgttgaaccaaatattagctttgatggcagcatacagtgttctggaaaagatgccattctttttaagcttgaaactgcagaagaaattcacaggaaaaatcaacaagatagtgatctctctgtgaaaatgctaaaagattttcttgaagatgacactgacgtgaaccagtatcttttaccaccaaagtcattgctgcgatatgctcttctgttagacattgttcagcccacttgtagaaggtccgtgtgctttaccaaaggatatggaagctacatagaagggacagggtctgtgttacagactgcagaggatgtgcaggttgagaatatctacaaatcccttaccaatttgtcacaagaagaacagataacaaagctgttaatacttaaactgcgatatttcactcctaaagaaatagcaaatctccttggatttcctccagagttcgatgagcaatcagacatactcttgaagacagaaaagagattaactattcaattaaaatgaattcctcagcttttcttcagtgcttttttgttttcaaagggcagtagtcactttggtaatactgaaccttggtaaggagcacagagcccagagtcagactgaatgatttcatatcccagccccaccttaaccgttcccttctttagtttacttctctgtaaaatgaggatgatcataactcctgcttcatagagttattgtgatagttaaatgagtcaatgtttatgaaattcttatctaatatctgagacataatgtaaaatttgttttagctttcatttttagaatgagccatgtatttacttttataatctttatttcataaatatttttctcattttttaaaattttaagttggtgaaatagaatttttcaaagctctttgaatatatatgtataatacttagaaaaacagcctttgaaattactgaacctccttctaaaatacgtgatatgtttttggagttgagcttaccctgatgtcaccactgagcagcaccgtgacacaactgtccctcatgtgtgttccaacattattgaccctgggtccaaaaatgggcattgtttgagctgtttgtctactggcaatgatggatctgcattgatccttccaaaccctctgtcctgg

SEQ ID NO: 304285 - DNA, 2944 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304286 - DNA, 3071 bp, Homo sapiens
  misc_feature (2451)..(2451): n is a, c, g, or t
  misc_feature (2457)..(2457): n is a, c, g, or t
  misc_feature (2459)..(2459): n is a, c, g, or t
  misc_feature (2471)..(2471): n is a, c, g, or t
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccgagtggaggacaagacgggggaacacgaggggccttcaagngttaananccttgtggggangctgggggggggggggggggcgggcgggggcggggggggcggggggggggggggggggggggggggggggggggggggggggggaggtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304287 - DNA, 2619 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggc

SEQ ID NO: 304288 - DNA, 2921 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304289 - DNA, 2862 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcaccctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304290 - DNA, 2369 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaacttgggggctctctttggggggggggaaaaaaggggttctgacgggcccgtggcaaaggtgttcctgccccagttttttggcaaggggaaacggcggccccatgggggcgaaaattcgaaccggtacgtag

SEQ ID NO: 304291 - DNA, 2890 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304292 - DNA, 2881 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304293 - DNA, 2928 bp, Homo sapiens
  misc_feature (15)..(15): n is a, c, g, or t
  misc_feature (35)..(35): n is a, c, g, or t
aagggctagtagagnctgggtgttaatcggccgangcgagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304294 - DNA, 2363 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaaaaaaaaaaaaaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304295 - DNA, 2081 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgagatggggtcttgctatattgcccagtcttggcctcaagtaatcctcctgcctcagtcgacc

SEQ ID NO: 304296 - DNA, 2246 bp, Homo sapiens
  misc_feature (1766)..(1766): n is a, c, g, or t
  misc_feature (1769)..(1769): n is a, c, g, or t
  misc_feature (1844)..(1844): n is a, c, g, or t
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacaggagatgggaaaccacgctatgatactttctggaaacattttatatttgttatgatggacattttgctcgattggagcatgcataatatcttntgntacctgtgtggaatttcagctttcctcatgcaaaaggattttgtatccccggcctacttgaagaagtggtcagcntaaaggacatccaggttgtttaggtttgggactgtataaatacctttgatggaaaaagacgttactaacgaatcccatctttgagttccccagcttaatatcacttgaccaggcaattgggttagggaaaggcaactttgtccgaaaagcccctttccaaacgttatccataaagaaaacgttgttgtccaacccgaggagtggaggaggaaaccgcgaaaacaaagccggtgggggtgtttttcccaaggtaaagaagaaccttttggtgccccaagtggggtggtatccccctttccaaaatttaacccaaatgtggggccgaaatttaattttccaaagaaaccaagtttaaccgccgccggttttttgggttggcccattaaaaggaccgcctccgaa

SEQ ID NO: 304297 - DNA, 1631 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcact

SEQ ID NO: 304298 - DNA, 2851 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304299 - DNA, 2672 bp, Homo sapiens
cggagggcaccggagttgctctaggtcgtaaccagcctttgaaaaaggagaaaccaaaatggaaaagcgatcatccctcttgctgcgtagttgtccatctgtcgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304300 - DNA, 2887 bp, Homo sapiens
acaaggcacactcccggcccttgatcgctcccagtgtctagggatctccggacttgaggttttatatttacagaagacagcagatatgtatatagtttctgtgcgcctgacgctaaggttacatacagccaggaacaaggtcaaaagtgtccctggtttacagagtgtacatcggaatgggggaggcaagccttaaacaagtaaacacataaatgagataactttaagagagtgaaaggtgcaatgaagaaatcgggggaactcgaaggaaagagttacgctattttatttagatggaatagtcaagagaaatcgtctccgaagaagcaacatttgaacagaaaccggaattataaggagccaggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacaatttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcacttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304301 - DNA, 949 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagtataatgctccggaattatcagaaagcataatgcagaaatacgaattagtggaacttaatcatgtgccatataagcttacctaacaaacagttatatccctattcctcaactgaatgtctttcaataaataagaatatatcatt

SEQ ID NO: 304302 - DNA, 777 bp, Homo sapiens
tgggtgccatgtgccctgagttttcccccccgcctctccaccctgggggcccccgggggacccggctccataaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304303 - DNA, 814 bp, Homo sapiens
ggtgaggtggggggggtcaacctgagcccccaaattttaaggtgccaagggccccgggttcccccccgcccgacaaccctggggggcccctggggacccgaattttttaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304304 - DNA, 617 bp, Homo sapiens
cctcccaaggtatgacggaattgcttggatcaatatcgtaactctacatgttaaccactttgaagaactaccagacgtttttcacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaaaaaa

SEQ ID NO: 304305 - DNA, 266 bp, Homo sapiens
catttgaacatcaccttgagaattagttgtattttgtttgaacacagggttaagtgaaaagctaatttggggaggtgatttggaatgtcaggtagtccaggttgcagtgtagaaagaacacactgaaaggatggtcagtgtaatgttagaggactgtgaaagttggggaaagaagtttagtttgtaggtacttgtttttttgagcagggaattgtcttggctggaggtgaacgtcagaaaggttaatgtaggcaagtgtagaatgg

SEQ ID NO: 304306 - DNA, 1211 bp, Homo sapiens
ttttaaattcctactgtctttcagaagcaggagtgtaaaactgtcctcagatgctcagatgtttgcttcttgtcagtggaagtgggaatatgggtttgctactttagcgaacttccttgttcatgaagatgttttttatcttctagaaatattttggtgagcagggtcaggggtttctgtgttttggagcctgaacctggaagccatagaactagaagtcgaggaaaaaaaggaagggtcgagccaggtctggtggctcaagcctgtaatcccagcactttgggaggccaaggcgggagaatcacgaggtcaggagttctagaccagcctgaccaacatggtgaaaccccgtctctactcaaaatacaaaaataagctgggcgtggtggtggttgcctctaattccagctacttgggaggctgaggtaggaaaatcgcttgaaaccggaaggcagagattatggtgagccaagattgtgccactgctctccagcctgggtgaaagagggaaactccatctcaaaaaaaaaaggaagcgtcaactccaagctgctcaaaatgtatcatattgtggctcgatcgctggaagccactatgaggaaaataggacaggagatgtgcacgtgtcctccacggtccccatcccccatcctctgtgccctgcagggcttccgaagtgaaagccgagttggagatgagaagggcaatctgtgcaggctttccttgtctttatggagtgccagggtctcaaggaagaaaaggtacgagcactgtgaggcctcggcagctctgcatgctggggatttgggcagcctctgtagagaagtaagagtgcagcacccgtgtcctggtgtggtggttcaggatttgcaaggcagagttgctctttttctctgagtaacagctagtgggctctgctcagttatccgtggtagacatctgctgaatgaggagtgagttcacctcagctcacgtttagagattggctttagggcacctgccagtggagtactagagtgaggcccacggcctggcccctcccagggagcttggtgtcctcctgctgctgttcctgcatgtgaggcgcaggggacactgggacaacacggattttttagtgccagggtagctgtgtagaccaagtgttgcgggagttgatggtgtagaaagctctctggaataggattgtgaagatctaggacttgaaatgg

SEQ ID NO: 304307 - DNA, 433 bp, Homo sapiens
cctgctctgcactctcaggtattccctgctcttactccaaaaagatggacccaggtccgaaggggcactgccactgtggggggcatggccatcctccaggtcactgcgggccaccccctggccatggcccagggccctgcgggccacccccccaccatggtccagggccctgcgggccaccccctggccatggcccagggccctgcgggccacccccccaccatggtccagggccctgcgggcctccccctggccatggcccaggtcacccaccccctggtccacatcactgaggaagtagaagaaaacaggacacaagatggcaagcctgagagaattgcccagctgacctggaatgaggcctaaaccacaatcttctcttcctaataaacagcctcctagaggccacattctattctttaaaaaaaaaaac

SEQ ID NO: 304308 - DNA, 455 bp, Homo sapiens
gggaagtggagtgagggagagctgatctcaggtaagcttagccctgacctctgactctgacattgttcatttgactttccacaggggcactgccactgtggggggcatggccatcctccaggtcactgcgggccaccccctggccatggcccagggccctgcgggccacccccccaccatggtccagggccctgcgggccaccccctggccatggcccagggccctgcgggccacccccccaccatggtccagggccctgcgggcctccccctggccatggcccaggtcacccaccccctggtccacatcactgaggaagtagaagaaaacaggacacaagatggcaagcctgagagaattgcccagctgacctggaatgaggcctaaaccacaatcttctcttcctaataaacagcctcctagaggccacattctattctttaaaaaaaaaaac

SEQ ID NO: 304309 - DNA, 373 bp, Homo sapiens
aagaattcggcacgaggctctcaggtattccctgctcttactccaaaaagatggacccaggtccgaaggggcactgccactgtggggggcatggccatcctccaggtcactgcgggccaccccctggccatggcccagggccctgcgggccacccccccaccatggtccagggccctgcgggcctccccctggccatggcccaggtcacccaccccctggtccacatcactgaggaagtagaagaaaacaggacacaagatggcaagcctgagagaattgcccagctgacctggaatgaggcctaaaccacaatcttctcttcctaataaacagcctcctagaggccacattctattctttaaaaaaaaaaac

SEQ ID NO: 304310 - DNA, 1663 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggc

SEQ ID NO: 304311 - DNA, 791 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgtccctatttcagtatattaaaagatgtgtattagtccgttttcacgccgctgataaagacatacctgagactgggcaatttacaaaagaggtttaatggacttaacagtttcacatggctggagaggcctcacaatcatgcagaaggcaaggaggaccaagtcacatcttatgtggatggcggcaggcaaagagagagagactgtgcagggatctcttgtttttaaaaccatcagatctcatgagacttattgtcatgagaacagcacaggaaagacttgcccccatgattcaattactttccatcgagtccctcccacaacatgtgggaattcaagatgagatttgggtgggg

SEQ ID NO: 304312 - DNA, 4218 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttattttttaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttaacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcca

SEQ ID NO: 304313 - DNA, 4135 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttattttttaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttaacatcaagaatccagatttttaaatgtaattgttttttaaatgctaatgtttgtaaagcaccttcagttcttcggatgaaaggtgctatattccctcagtgtaaattaataaaaagattacaggaagtttgtca

SEQ ID NO: 304314 - DNA, 3563 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttattttttaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgaga

SEQ ID NO: 304315 - DNA, 4175 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttattttttaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttaacatcaagaatccagatttttaaatgtaattgttttttaaatgtatattccctcagtgtaaattaataaaaagattacaggaagtttgtcaaaaaattcaatgcatagtctgtagtatgtcctgacaagaagttagcattttatataagaaattaaaaaatgcttattcctcca

SEQ ID NO: 304316 - DNA, 4164 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttattttttaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatccttgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttaacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcca

SEQ ID NO: 304317 - DNA, 1978 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggcaaaaaaaaaaaaaaaaaaaaaaaaaaaaaaaaaaaaaaaaaaaaaaaagaagagaaaaaagggagagagaagtaatatatgagatgtagataataaactagaagatgaaaaaacaaatgtgataaagactggctaaaaagaaagaaagaaatataatagaaaagaggaatgacagcacattaaatgctaacaatctagattggaatataggaaagatagatagagaatagactaagtaagaaaaaaaaacatatatgataagaaatgtaaagttatgagaagattagataaagaatataataatattaagattaa

SEQ ID NO: 304318 - DNA, 2954 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttattttttaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaaaaaaaaaaaaaaaaaaaaaaaaaaaaaaaaaaaaaaaaaaaaaaaaaagaagagaaaaaagggagagagaagtaatatatgagatgtagataataaactagaagatgaaaaaacaaatgtgataaagactggctaaaaagaaagaaagaaatataatagaaaagaggaatgacagcacattaaatgctaacaatctagattggaatataggaaagatagatagagaatagactaagtaagaaaaaaaaacatatatgataagaaatgtaaagttatgagaagattagataaagaatataataatattaagattaa

SEQ ID NO: 304319 - DNA, 1602 bp, Homo sapiens
  misc_feature (1532)..(1532): n is a, c, g, or t
  misc_feature (1540)..(1540): n is a, c, g, or t
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttttggggtaaagttttttaaagaaaanttttcaangcaagccaaaaagtttgtttaatttccagttgggggcaccgaatgggaactccccaaaattg

SEQ ID NO: 304320 - DNA, 4108 bp, Homo sapiens
gctcagaccatgcttttgccgcgcgtggtcattctgtaaatgaccctgctcatacctggtcacctatgtgatcctggtcctgattagtgcttgcctgctacaacagatgaaacctggaagcccggggtatgtacactgagctgttcgtgaccctcacatcctaaataggagtccatgtagtgtcatgtcacatgatctcctcatccaagtaggcagtccgtgtgcgagcatcttcctatcggaacatttactgcctcgcccttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttattttttaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttaacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcca

SEQ ID NO: 304321 - DNA, 4010 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttattttttaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttaacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcca

SEQ ID NO: 304322 - DNA, 1432 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgctctgcttttgttaaatttcactatctaatttcgtgtgggggcttgccaagttacaatatccccaacccccccgggcttggaggctcgaggttacccaggggggccggataagggcgaacaagggttaagacggaaagcaacttgtacacgggggaaaagcagttggggacgtatcccatgggttaaagagcgggcttggacca

SEQ ID NO: 304323 - DNA, 3414 bp, Homo sapiens
aaatgattatgtaggccgattgttttttaagtgctaagtacttacagtgcctttctaaattgcagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttattttttaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttaacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcca

SEQ ID NO: 304324 - DNA, 3606 bp, Homo sapiens
agatgagcatgattacgtgtgttcacggtgttttatcgtccgtgatatcgaatgactgacatcgaaattcgagacttcgaaaggaatctggaaattcttcataaatgagcattccgtcgatcattgtgtctaaggtctagatctctagaatatgttggataccgtgggctaatcagtagctcagtaggaagaaggctgggagttgttgtaggatgcgaacatggtcatcaaggtgaatttggtgcttattgattagaaacttaataagtaatattggagagccaagatctaggttagtcgcgacgtagaggattatcaggatatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttattttttaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcactactttatattcatttgagtgtgatcctaaaacacctggatcaacagtacatctcatatgcaatctgcatcagctcctattctgtctggatgtctagaactgttggaagattttgacgtcttaagccctaggttttgctttgggaaataaggtttgaaatattgttcattgcattaagatttgtgtgtgtgtgctttgtaagcccagaaccaggttttggaaaatgcctgtactgtgaaagcaaattaggactctttctgagcctctttcattgtcagaaatagaatcactttccatcagcttccaggaaattgtgtatctggagtcgaagagatttaacatcaagaatccagatttttaaatgtaattgttttttaaatgctaatgtttgtaaagcaccttcagttcttcggatgaaaggtgctatattccctcagtgtaaattaataaaaagattacaggaagtttgtcaaaaaattcaatgcatagtctgtagtatgtcctgacaagaagttagcattttatataagaaattaaaaaatgcttattcctcca

SEQ ID NO: 304325 - DNA, 1057 bp, Homo sapiens
tgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgaggtaaagccaacatttttggaaatgtaatttgtggattgctaatgggctgcatagagaactatggtggccctagataacaaacttgtagtctagcttactcaaaatatggtggctgtggatattaaatttctagtttagttattaacgtatgtctttctttaatggttaaataagatgacacagtgaaa

SEQ ID NO: 304326 - DNA, 603 bp, Homo sapiens
gcctgggtgacagagtgatactgtctcaaaaaaagaaaaaaaagaaaaaaaaatggtggttttttttttcagggaaagtttttgagagaatggcacagcagattcttgtagatttccctggaatcaaaaatcttgtttgtataaacatttaatagaaaaaatttgtttacgtgtattttatttttttgttaaaatcaaatttccaaataattcagtatgtaactctttattgtagttataaactatatgtttgtacagtttgatataatttgaaaagaatattgtggctattgtattgtttgtaactgtaaacttttacttcacagggtgattttgtagacagaggttactatagtttggagaccttcacttaccttcttgcattaaaggctaaatggcctgatcgtattacacttttgcgaggaaatcatgagagtagacagataacacaggtctatggattttatggtaagaattcctatttctctgattctgaatattattttactttcctctttggaaaacaaagctacacaagtcatacacatgctttatgtatattattttccccacatcctcactccttcactcctcccaaacaat

SEQ ID NO: 304327 - DNA, 1250 bp, Homo sapiens
ggcacgaggctttgtggtttggtctcagggaagtagcaggcgccggttgagagaactacggccctgtcggaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaaaaaaaaaaaaatataaaacaataaaaaaaagaacacaagaacacaaaaaaaaactcggggacaaaaataagggcggggaacaaa

SEQ ID NO: 304328 - DNA, 1615 bp, Homo sapiens
ggcacgaggctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304329 - DNA, 980 bp, Homo sapiens
  misc_feature (949)..(949): n is a, c, g, or t
  misc_feature (954)..(954): n is a, c, g, or t
aatatagggctaggtacgaggctgggtgtcgccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagcggnagccngaggttagatagcaaaaggaaatctg

SEQ ID NO: 304330 - DNA, 1368 bp, Homo sapiens
ggcacgaggctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccggtaagccaggtcccggagaccaaccctcccactgccagaccttcctcagccacatggactggctttgggacagggtggggagagttctccccttggggcttcagacccctcctttccatttctttatagagatgtgtttctctctctcttttggggggtattgagcacctagatgatgctatctcctttcgaaactcttgttccctccttgtgactgtttctcaaggtctttcttcatggctatgacttggtttcgctctctccgtggccttgattttgtcgcctgtgtcttgtaactcattgtgcatgtagaaaatccaagtgtctactaagcaactgttaggattaataagtgaacttaaatttagaaagatcgctggatataaaggcaatatgga

SEQ ID NO: 304331 - DNA, 618 bp, Homo sapiens
cttgatttaggttgcagttgcatgggtgtttgtgtttaaatttttcattaaatgctatgtttacattagagtttttcaacttagtactatctgcattttgggctggataattctgagtaatggggccctgccctgtgcattggaggctatttggcatcatttctggcctctgtccacttgatgccgttacgttagggggaaatgctgagtccctgaggtctgtcgttctctttcaggttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304332 - DNA, 881 bp, Homo sapiens
gcgagacgcgtacagactcgtgaccttcactgattggtccgtagacccgggcgccacggaaggagagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagtaagtggggcctgtggctgggtggtccctggagggtgatggccaggaggcatctccatggaaacaggcctcagaactctgccagcagagctctgagccaagtagggctttgcagaagggacagcgaccaaagatgtgaaaggaggaggctgtggctgggcccacggcctgtgggggacatgggggtgaggctggaaagg

SEQ ID NO: 304333 - DNA, 523 bp, Homo sapiens
cttgatttaggttgcagttgcatgggtgtttgtgtttaaatttttcattaaatgctatgtttacattagagtttttcaacttagtactatctgcattttgggctggataattctgagtaatggggccctgccctgtgcattggaggctatttggcatcatttctggcctctgtccacttgatgccgttacgttagggggaaatgctgagtccctgaggtctgtcgttctctttcaggttccctggcttcaaggaggtccgtctggtacccgggcggcatgacatcgccttcgtggagtttgacaatgaggtacaggcaggggcagctcgcgatgccctgcagggctttaagatcaccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304334 - DNA, 1609 bp, Homo sapiens
  misc_feature (12)..(12): n is a, c, g, or t
  misc_feature (32)..(32): n is a, c, g, or t
  misc_feature (64)..(64): n is a, c, g, or t
aggtcgcgtaancataggctaggtgcgaggcntggtgtgaatcggccgaggctcggcctgtcgnaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304335 - DNA, 1699 bp, Homo sapiens
ggcacgaggctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaaaaaaaaaaaaatataaaacaataaaaaaaagaacacaagaacacaaaaaaaaactcggggacaaaaataagggcggggaacaaa

SEQ ID NO: 304336 - DNA, 1238 bp, Homo sapiens
aatatagggctaggtacgaggctgggtgtcgccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304337 - DNA, 1226 bp, Homo sapiens
  misc_feature (12)..(12): n is a, c, g, or t
  misc_feature (32)..(32): n is a, c, g, or t
  misc_feature (64)..(64): n is a, c, g, or t
aggtcgcgtaancataggctaggtgcgaggcntggtgtgaatcggccgaggctcggcctgtcgnaagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304338 - DNA, 1433 bp, Homo sapiens
ggcacgaggctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagtaagtggggcctgtggctgggtggtccctggagggtgatggccaggaggcatctccatggaaacaggcctcagaactctgccagcagagctctgagccaagtagggctttgcagaagggacagcgaccaaagatgtgaaaggaggaggctgtggctgggcccacggcctgtgggggacatgggggtgaggctggaaagg

SEQ ID NO: 304339 - DNA, 1257 bp, Homo sapiens
gtcacttggcgtccgtcgtttgccctagtcgcggcttagctgcactttccggtttcgggcaggacagatgccttgacggcagcgctaccggtggcgtgacgagaagcgactggtgcgacgcaagaggccgagggcgtagagagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304340 - DNA, 1166 bp, Homo sapiens
ggcacgaggctttgtggtttggtctcagggaagtagcaggcgccggttgagagaactacggccctgtcggaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304341 - DNA, 1231 bp, Homo sapiens
ggcacgaggctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagccttgcagctttttggatcccgatcattgtctacactgcagggacaaagtctgggccagttcacgcctggtcagggggctggtcgggggg

SEQ ID NO: 304342 - DNA, 1314 bp, Homo sapiens
agcggatattcgccagcgcgtcgcagaataatcgaggctcctactcacacgtttgattgatcgctcattggcctccgcaccttccacccgtactcaccgagttggcatgcacttactatgtaggagtgaagagtcgtgtgagcccacgacgttggacgacgggagtcggagaatcccagggctaacggtcacgtgtatgtgctgtccgtgtataagacgttacctccatggagttcgctgtccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304343 - DNA, 1123 bp, Homo sapiens
  misc_feature (7)..(7): n is a, c, g, or t
  misc_feature (66)..(66): n is a, c, g, or t
  misc_feature (84)..(84): n is a, c, g, or t
  misc_feature (105)..(105): n is a, c, g, or t
  misc_feature (115)..(115): n is a, c, g, or t
cgccacntgaacaagattgagaaccaggctaatacgtttcctctttaaactcctccaacttacgcntgccgtcccacaccgccnaacacactatttttcgacacntaatgagagntcagaaggtgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304344 - DNA, 1295 bp, Homo sapiens
gaaaagaatcactcatttatcgagtgtttactacgtgccggatgctgtcctgagcactttgcatgtatgtgcacatgttcattatatagcagctctctgtaagcacatcttacagaagagtagaagagtgtacttggccacttgagtggttcctggctgcttctgtgattgttaggtcttgagagattatggacccgaggcattctgggtaccccatcaattggctgatggtcttctatttgggctgcgcttcttctaaaaaggggagctcaaaggtctttttttcccccactgcagagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304345 - DNA, 1552 bp, Homo sapiens
ggcacgaggctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggagcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacccccgtggtgggggctgtccaggggcctgtcccgggcatgccgccgatgactcaggcgccccgcattatgcaccacatgccgggccagccgccctacatgccgccccctggtatgatccccccgccaggccttgcacctggccagatcccaccaggggccatgcccccgcagcagcttatgccaggacagatgccccctgcccagcctctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304346 - DNA, 1102 bp, Homo sapiens
ggcacgaggctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattgccaagatgaaaggcaccttcgtggagcgggaccgcaagcgggagaagaggaagcccaagagccaggagaccccggccaccaagaaggctgtgcaaggcgggggagccacttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304347 - DNA, 1174 bp, Homo sapiens
ggcacgaggctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagcctgaagatgaggggccaggcctttgtcatcttcaaggaggtcagcagcgccaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304348 - DNA, 517 bp, Homo sapiens
tggactcagggctcttgtgctcaccgactcccctatacccccgcagctttctgagaatccaccgaatcacatcttgttcctcaccaacctgccagaggagaccaacgagctcatgctgtccatgcttttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304349 - DNA, 1147 bp, Homo sapiens
ggcacgaggctttgtggtttggtctcagggaagtagcaggcgccggttgagagaactacggccctgtcggaaggtaacctccggtgcaaacgaccatcggcggcaggcgagcggtacgcttggcgtccgggccttcctgggcccgtctgaggaaacttgctgctcgaggccaggctgcctaggacctgtcccttttttctatactggctcccacatccgggttttttctccgggacggcccttcggatgcttgggccaatgggaatcgccatttagggtgctccgcccaccgggtcgcgtagagcatcctggaagtcgtagtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatggtgagttctcgggatagtccggagtccagactgtcccgcacgggctggcccctcttccgtcccctgcacccgcctctctttctaagtgtttgtccagccaaacttcgagttaactccttggcctttacacaaactacttcctgtcttcaacactccattagttcatcttacactctgccctttaacgtggtcactgctgctcatcttacaaggtttgaggtcacaggacccttcctccaggaagccttgccttgtcccttcacgtggctgccgctgacttgccgtacgctgagaccatctcccatcaagccctgattcctctgagctgtcgtggggctctctctcctcccagtggcctttgaactccgtgagggcaaggactggggctttcttggtcaccggctttttcagtgatcagcccacaatgaacatgtaccataatggtggctaacgctctgtatcatgggctggtctgtgtgctttcatataaatcttgataacatttaattctcacaacaatcttgtaggaa

SEQ ID NO: 304350 - DNA, 452 bp, Homo sapiens
  misc_feature (17)..(17): n is a, c, g, or t
  misc_feature (62)..(62): n is a, c, g, or t
agaacctagaggatccncgctacaacgccaaggcgatcaacgagctcatgctgtccatgctnttcaatcagttccctggcttcaaggaggtccgtctggtacccgggcggcatgacatcgccttcgtggagtttgacaatgaggtacaggcaggggcagctcgcgatgccctgcagggctttaagatcacgcagaacaacgccatgaagatctcctttgccaagaagtagcaccttttccccccatgcctgccccttcccctgttctggggccacccctttcccccttggctcagccccctgaaggtaagtccccccttgggggccttcttggagccgtgtgtgagtgagtggtcgccacacagcattgtacccagagtctgtccccagacattgcacctggcgctgttaggccggaattaaagtggctttttgaggtttggtttttcacaa

SEQ ID NO: 304351 - DNA, 4414 bp, Homo sapiens
caggggccgctaacggtccggcgcccctcggcgtccgcgcgcccccagcctggcggacgagcccggcggcggagatgggggcgacgggggcggcggagccgctgcaatccgtgctgtgggtgaagcagcagcgctgcgccgtgagcctggagcccgcgcgggctctgctgcgctggtggcggagcccggggcccggagccggcgcccccggcgcggatgcctgctctgtgcctgtatctgagatcatcgccgttgaggaaacagacgttcacgggaaacatcaaggcagtggaaaatggcagaaaatggaaaagccttacgcttttacagttcactgtgtaaagagagcacgacggcaccgctggaagtgggcgcaggtgactttctggtgtccagaggagcagctgtgtcacttgtggctgcagaccctgcgggagatgctggagaagctgacgtccagaccaaagcatttactggtatttatcaacccgtttggaggaaaaggacaaggcaagcggatatatgaaagaaaagtggcaccactgttcaccttagcctccatcaccactgacatcatcgttactgaacatgctaatcaggccaaggagactctgtatgagattaacatagacaaatacgacggcatcgtctgtgtcggcggagatggtatgttcagcgaggtgctgcacggtctgattgggaggacgcagaggagcgccggggtcgaccagaaccacccccgggctgtgctggtccccagtagcctccggattggaatcattcccgcagggtcaacggactgcgtgtgttactccaccgtgggcaccagcgacgcagaaacctcggcgctgcatatcgttgttggggactcgctggccatggatgtgtcctcagtccaccacaacagcacactccttcgctactccgtgtccctgctgggctacggcttctacggggacatcatcaaggacagtgagaagaaacggtggttgggtcttgccagatacgacttttcaggtttaaagaccttcctctcccaccactgctatgaagggacagtgtccttcctccctgcacaacacacggtgggatctccaagggataggaagccctgccgggcaggatgctttgtttgcaggcaaagcaagcagcagctggaggaggagcagaagaaagcactgtatggtttggaagctgcggaggacgtggaggagtggcaagtcgtctgtgggaagtttctggccatcaatgccacaaacatgtcctgtgcttgtcgccggagccccaggggcctctccccggctgcccacttgggagacgggtcttctgacctcatcctcatccggaaatgctccaggttcaattttctgagatttctcatcaggcacaccaaccagcaggaccagtttgacttcacttttgttgaagtttatcgcgtcaagaaattccagtttacgtcgaagcacatggaggatgaggacagcgacctcaaggagggggggaagaagcgctttgggcacatttgcagcagccacccctcctgctgctgcaccgtctccaacagctcctggaactgcgacggggaggtcctgcacagccctgccatcgaggtcagagtccactgccagctggttcgactctttgcacgaggaattgaagagaatccgaagccagactcacacagctgagaagccggcgtcctgctcacaaactgggaaagtgtgaaaactatttaagataattattacagaccaattatgttgatatatacatttaaatgtagaaatttatttttgatagttaaatcttgattttagaagaaaacccttttgtcaacaattttgtgtacatatttggcattttcagttctgtacgcatctgcgggttgcagcccacgccgcttactctcagcggatgcagctgctcacttgggggcactggcctcttaggttttaacgatgtcaacagtgtagtttagaaaatggcccgttagtggctctattgcaataatgttagggacattatatgatttccacgcaggtcacaccatctgggcctgaggtagcagtgggtcactttgatccactttgcaggacttattctgtaacggtttgtggccaagttttgggaagtggttgattctctttgccttcatttcaccttcctcttcgtttacggttaggacatcgctgcttgatccttacaatactgtgcaactgcaatgcaacgtggccctgcttcaggtgatccgcgggaggggcctccacgccagcgccgggaaggctgctggggcctccacacctgcctcatcacggcggcgaggctacgacaatccggctgggagcatgaccttggcgtctgttctgggagcacggatgataagctctggaagctggcagtgtgtaaagcactggcaagtttgttactgttaaaatgtcaaataccaatgctttatatcgacgcgaagtgcttaacacagccgggcttgggggcagtcaggaggaagctggccatccgtggaggaggggccggtcctggactcccgcaggactcctctgatgcagggcctgaagtctgtacacgtggtccagatttgtccttgtcttttcttcacactgagttctctatatttattgaacatcttgtccttttaagccagagtagtgtaaactgcgtctcggatgtctgtcttttgcctcgaagccacgatggatcgctggtttcctctgcagcgcgagggctccggcgaccagaggattcttcccggaaggcattcctgccgcgctccccggggcacccctcaattgtgtactacgtccttgtttagtgtgtatccgtgcccacgtagatgatgtctgtaacgtagttttgtttgaaatatgagaatatgcggcttaaactttgatctgtaaggagcggggccgtggccgtttggagcacgctgtagacaccgttcctcatgctgccgggtgggttttgcagaagctcccttagtgatttcatgtttaacaggcagcatccattttcagaatttcctggcattgatttatattttgaagcatacaggaaacttctcgtttcctcgtttagccccacccagatcaggtgaaagggcagctttaatggtggtttttatggaccacattatcagagagcactgtgcaagccaaatggttcaataatgaatgaaaattctgggtgtaaagagtaaatatgccctggctctttctaccaatgtttgctcctggttggaaagaaaccaaagatttaagacgggctgctcttccagactggctgtgcctgcctgtgcccagcaacctgtgcagccggcagtgtgcctggtgtcacgccaggaggctgtggctgctgtgggccctctggaattgtgctcctcacaaagtttccccaaaaggttcttctaagcctttattgtccctggtaaatgtttcccggctgggcgcggtggctcacgcctgtaatcccagcactttgggaggccgaggcgggtggatcacctaaggtcaggagtttgagatcagcctgcccaacatggtgaaacctcgtctctactaaaaatacacaacttagccagtcttgttggcgcacgcctgtaatctcagctactagggatgctgaggcaggagaatcgcttgaacccaagaaagaggtggaggttgcggtgagccaagattgcgccactgcactccagcctgggcaaacagagggagactccatcgccccccctcaacaaaaaaaaaagtttcccatacactggcctgccccaaaacccactaacaattttagcaaaacagtccaggccaaagaggaagcatttcatgttcaataagaaacccagccattccgcatggctggttcctgagtggctctggtgatactctccagccacctgctgacattgagaatctcagacctcgggactgctgttgcggtaccgtgtgtctgacacctgccagcagccctttgctatctgcgcgcaggatgggggtgactgcccagacattcccgctagataggctctgatttccggggcagcctttcagatgcggcagacatacaacacctgtactttagagttttaagggaaaaaaaaatcagaagtgctggttagatagtaaaaacttaggataacttagaaaggctagttttagcttcctttgtggctccctggtgcaaaacaattagcagttatgcaatggacctgattctagtttattctaattaagaagtgaggccgggtttgacttcgttcctgaatacaatcttgagtaactgggaaagtctgagtgaaaggatggcctcattctctttctaatcttgctggtttcaagattagaaaatggcattatttgatctgaaatgtttgagaagacacgaataaagttacttgggcaga

SEQ ID NO: 304352 - DNA, 3063 bp, Homo sapiens
aaaaagatgatatagccgaccggtttattgcagttcgaggcatcagctggactaatttgacttcacttttgttgaagtttatcgcgtcaagaaattccagtttacgtcgaagcacatggaggatgaggacagcgacctcaaggagggggggaagaagcgctttgggcacatttgcagcagccacccctcctgctgctgcaccgtctccaacagctcctggaactgcgacggggaggtcctgcacagccctgccatcgaggtcagagtccactgccagctggttcgactctttgcacgaggaattgaagagaatccgaagccagactcacacagctgagaagccggcgtcctgctcacaaactgggaaagtgtgaaaactatttaagataattattacagaccaattatgttgatatatacatttaaatgtagaaatttatttttgatagttaaatcttgattttagaagaaaacccttttgtcaacaattttgtgtacatatttggcattttcagttctgtacgcatctgcgggttgcagcccacgccgcttactctcagcggatgcagctgctcacttgggggcactggcctcttaggttttaacgatgtcaacagtgtagtttagaaaatggcccgttagtggctctattgcaataatgttagggacattatatgatttccacgcaggtcacaccatctgggcctgaggtagcagtgggtcactttgatccactttgcaggacttattctgtaacggtttgtggccaagttttgggaagtggttgattctctttgccttcatttcaccttcctcttcgtttacggttaggacatcgctgcttgatccttacaatactgtgcaactgcaatgcaacgtggccctgcttcaggtgatccgcgggaggggcctccacgccagcgccgggaaggctgctggggcctccacacctgcctcatcacggcggcgaggctacgacaatccggctgggagcatgaccttggcgtctgttctgggagcacggatgataagctctggaagctggcagtgtgtaaagcactggcaagtttgttactgttaaaatgtcaaataccaatgctttatatcgacgcgaagtgcttaacacagccgggcttgggggcagtcaggaggaagctggccatccgtggaggaggggccggtcctggactcccgcaggactcctctgatgcagggcctgaagtctgtacacgtggtccagatttgtccttgtcttttcttcacactgagttctctatatttattgaacatcttgtccttttaagccagagtagtgtaaactgcgtctcggatgtctgtcttttgcctcgaagccacgatggatcgctggtttcctctgcagcgcgagggctccggcgaccagaggattcttcccggaaggcattcctgccgcgctccccggggcacccctcaattgtgtactacgtccttgtttagtgtgtatccgtgcccacgtagatgatgtctgtaacgtagttttgtttgaaatatgagaatatgcggcttaaactttgatctgtaaggagcggggccgtggccgtttggagcacgctgtagacaccgttcctcatgctgccgggtgggttttgcagaagctcccttagtgatttcatgtttaacaggcagcatccattttcagaatttcctggcattgatttatattttgaagcatacaggaaacttctcgtttcctcgtttagccccacccagatcaggtgaaagggcagctttaatggtggtttttatggaccacattatcagagagcactgtgcaagccaaatggttcaataatgaatgaaaattctgggtgtaaagagtaaatatgccctggctctttctaccaatgtttgctcctggttggaaagaaaccaaagatttaagacgggctgctcttccagactggctgtgcctgcctgtgcccagcaacctgtgcagccggcagtgtgcctggtgtcacgccaggaggctgtggctgctgtgggccctctggaattgtgctcctcacaaagtttccccaaaaggttcttctaagcctttattgtccctggtaaatgtttcccggctgggcgcggtggctcacgcctgtaatcccagcactttgggaggccgaggcgggtggatcacctaaggtcaggagtttgagatcagcctgcccaacatggtgaaacctcgtctctactaaaaatacacaacttagccagtcttgttggcgcacgcctgtaatctcagctactagggatgctgaggcaggagaatcgcttgaacccaagaaagaggtggaggttgcggtgagccaagattgcgccactgcactccagcctgggcaaacagagggagactccatcgccccccctcaacaaaaaaaaaagtttcccatacactggcctgccccaaaacccactaacaattttagcaaaacagtccaggccaaagaggaagcatttcatgttcaataagaaacccagccattccgcatggctggttcctgagtggctctggtgatactctccagccacctgctgacattgagaatctcagacctcgggactgctgttgcggtaccgtgtgtctgacacctgccagcagccctttgctatctgcgcgcaggatgggggtgactgcccagacattcccgctagataggctctgatttccggggcagcctttcagatgcggcagacatacaacacctgtactttagagttttaagggaaaaaaaaatcagaagtgctggttagatagtaaaaacttaggataacttagaaaggctagttttagcttcctttgtggctccctggtgcaaaacaattagcagttatgcaatggacctgattctagtttattctaattaagaagtgaggccgggtttgacttcgttcctgaatacaatcttgagtaactgggaaagtctgagtgaaaggatggcctcattctctttctaatcttgctggtttcaagattagaaaatggcattatttgatctgaaatgtttgagaagacacgaataaagttacttgggcaga

SEQ ID NO: 304353 - DNA, 4547 bp, Homo sapiens
  misc_feature (4426)..(4426): n is a, c, g, or t
caggggccgctaacggtccggcgcccctcggcgtccgcgcgcccccagcctggcggacgagcccggcggcggagatgggggcgacgggggcggcggagccgctgcaatccgtgctgtgggtgaagcagcagcgctgcgccgtgagcctggagcccgcgcgggctctgctgcgctggtggcggagcccggggcccggagccggcgcccccggcgcggatgcctgctctgtgcctgtatctgagatcatcgccgttgaggaaacagacgttcacgggaaacatcaaggcagtggaaaatggcagaaaatggaaaagccttacgcttttacagttcactgtgtaaagagagcacgacggcaccgctggaagtgggcgcaggtgactttctggtgtccagaggagcagctgtgtcacttgtggctgcagaccctgcgggagatgctggagaagctgacgtccagaccaaagcatttactggtatttatcaacccgtttggaggaaaaggacaaggcaagcggatatatgaaagaaaagtggcaccactgttcaccttagcctccatcaccactgacatcatcgttactgaacatgctaatcaggccaaggagactctgtatgagattaacatagacaaatacgacggcatcgtctgtgtcggcggagatggtatgttcagcgaggtgctgcacggtctgattgggaggacgcagaggagcgccggggtcgaccagaaccacccccgggctgtgctggtccccagtagcctccggattggaatcattcccgcagggtcaacggactgcgtgtgttactccaccgtgggcaccagcgacgcagaaacctcggcgctgcatatcgttgttggggactcgctggccatggatgtgtcctcagtccaccacaacagcacactccttcgctactccgtgtccctgctgggctacggcttctacggggacatcatcaaggacagtgagaagaaacggtggttgggtcttgccagatacgacttttcaggtttaaagaccttcctctcccaccactgctatgaagggacagtgtccttcctccctgcacaacacacggtgggatctccaagggataggaagccctgccgggcaggatgctttgtttgcaggcaaagcaagcagcagctggaggaggagcagaagaaagcactgtatggtttggaagctgcggaggacgtggaggagtggcaagtcgtctgtgggaagtttctggccatcaatgccacaaacatgtcctgtgcttgtcgccggagccccaggggcctctccccggctgcccacttgggagacgggtcttctgacctcatcctcatccggaaatgctccaggttcaattttctgagatttctcatcaggcacaccaaccagcaggaccagtttgacttcacttttgttgaagtttatcgcgtcaagaaattccagtttacgtcgaagcacatggaggatgaggacagcgacctcaaggagggggggaagaagcgctttgggcacatttgcagcagccacccctcctgctgctgcaccgtctccaacagctcctggaactgcgacggggaggtcctgcacagccctgccatcgaggtcagagtccactgccagctggttcgactctttgcacgaggaattgaagagaatccgaagccagactcacacagctgagaagccggcgtcctgctcacaaactgggaaagtgtgaaaactatttaagataattattacagaccaattatgttgatatatacatttaaatgtagaaatttatttttgatagttaaatcttgattttagaagaaaacccttttgtcaacaattttgtgtacatatttggcattttcagttctgtacgcatctgcgggttgcagcccacgccgcttactctcagcggatgcagctgctcacttgggggcactggcctcttaggttttaacgatgtcaacagtgtagtttagaaaatggcccgttagtggctctattgcaataatgttagggacattatatgatttccacgcaggtcacaccatctgggcctgaggtagcagtgggtcactttgatccactttgcaggacttattctgtaacggtttgtggccaagttttgggaagtggttgattctctttgccttcatttcaccttcctcttcgtttacggttaggacatcgctgcttgatccttacaatactgtgcaactgcaatgcaacgtggccctgcttcaggtgatccgcgggaggggcctccacgccagcgccgggaaggctgctggggcctccacacctgcctcatcacggcggcgaggctacgacaatccggctgggagcatgaccttggcgtctgttctgggagcacggatgataagctctggaagctggcagtgtgtaaagcactggcaagtttgttactgttaaaatgtcaaataccaatgctttatatcgacgcgaagtgcttaacacagccgggcttgggggcagtcaggaggaagctggccatccgtggaggaggggccggtcctggactcccgcaggactcctctgatgcagggcctgaagtctgtacacgtggtccagatttgtccttgtcttttcttcacactgagttctctatatttattgaacatcttgtccttttaagccagagtagtgtaaactgcgtctcggatgtctgtcttttgcctcgaagccacgatggatcgctggtttcctctgcagcgcgagggctccggcgaccagaggattcttcccggaaggcattcctgccgcgctccccggggcacccctcaattgtgtactacgtccttgtttagtgtgtatccgtgcccacgtagatgatgtctgtaacgtagttttgtttgaaatatgagaatatgcggcttaaactttgatctgtaaggagcggggccgtggccgtttggagcacgctgtagacaccgttcctcatgctgccgggtgggttttgcagaagctcccttagtgatttcatgtttaacaggcagcatccattttcagaatttcctggcattgatttatattttgaagcatacaggaaacttctcgtttcctcgtttagccccacccagatcaggtgaaagggcagctttaatggtggtttttatggaccacattatcagagagcactgtgcaagccaaatggttcaataatgaatgaaaattctgggtgtaaagagtaaatatgccctggctctttctaccaatgtttgctcctggttggaaagaaaccaaagatttaagacgggctgctcttccagactggctgtgcctgcctgtgcccagcaacctgtgcagccggcagtgtgcctggtgtcacgccaggaggctgtggctgctgtgggccctctggaattgtgctcctcacaaagtttccccaaaaggttcttctaagcctttattgtccctggtaaatgtttcccggctgggcgcggtggctcacgcctgtaatcccagcactttgggaggccgaggcgggtggatcacctaaggtcaggagtttgagatcagcctgcccaacatggtgaaacctcgtctctactaaaaatacacaacttagccagtcttgttggcgcacgcctgtaatctcagctactagggatgctgaggcaggagaatcgcttgaacccaagaaagaggtggaggttgcggtgagccaagattgcgccactgcactccagcctgggcaaacagagggagactccatcgccccccctcaacaaaaaaaaaagtttcccatacactggcctgccccaaaacccactaacaattttagcaaaacagtccaggccaaagaggaagcatttcatgttcaataagaaacccagccattccgcatggctggttcctgagtggctctggtgatactctccagccacctgctgacattgagaatctcagacctcgggactgctgttgcggtaccgtgtgtctgacacctgccagcagccctttgctatctgcgcgcaggatgggggtgactgcccagacattcccgctagataggctctgatttccggggcagcctttcagatgcggcagacatacaacacctgtactttagagttttaagggaaaaaaaaatcagaagtgctggttagatagtaaaaacttaggataacttagaaaggctagttttagcttcctttgtggctccctggtgcaaaacaattagcagttatgcaatggacctgattctagtttattctaattaagaagtgaggccgggtttgacttcgttcctgaatacaatcttgagtaactgggaaagtctgagtgaaaggatggcctcattctctttctaatcttgctggtttcaagattagaaaatggcattatttgatctgaaatgtttgagaagacacgaataaagttacttgggcagaaaaaaaaaaaanaaaaaaaaaaactgagggggggcccgtcccatatcccctaagggagtgattacaataattgccggcgttacaagtcggacggaaaaccgcgtaccaattatgcctgaaaatccctttgcat

SEQ ID NO: 304354 - DNA, 4360 bp, Homo sapiens
caggggccgctaacggtccggcgcccctcggcgtccgcgcgcccccagcctggcggacgagcccggcggcggagatgggggcgacgggggcggcggagccgctgcaatccgtgctgtgggtgaagcagcagcgctgcgccgtgagcctggagcccgcgcgggctctgctgcgctggtggcggagcccggggcccggagccggcgcccccggcgcggatgcctgctctgtgcctgtatctgagatcatcgccgttgaggaaacagacgttcacgggaaacatcaaggcagtggaaaatggcagaaaatggaaaagccttacgcttttacagttcactgtgtaaagagagcacgacggcaccgctggaagtgggcgcaggtgactttctggtgtccagaggagcagctgtgtcacttgtggctgcagaccctgcgggagatgctggagaagctgacgtccagaccaaagcatttactggtatttatcaacccgtttggaggaaaaggacaaggcaagcggatatatgaaagaaaagtggcaccactgttcaccttagcctccatcaccactgacatcatcgttactgaacatgctaatcaggccaaggagactctgtatgagattaacatagacaaatacgacggcatcgtctgtgtcggcggagatggtatgttcagcgaggtgctgcacggtctgattgggaggacgcagaggagcgccggggtcgaccagaaccacccccgggctgtgctggtccccagtagcctccggattggaatcattcccgcagggtcaacggactgcgtgtgttactccaccgtgggcaccagcgacgcagaaacctcggcgctgcatatcgttgttggggactcgctggccatggatgtgtcctcagtccaccacaacagcacactccttcgctactccgtgtccctgctgggctacggcttctacggggacatcatcaaggacagtgagaagaaacggtggttgggtcttgccagatacgacttttcaggtttaaagaccttcctctcccaccactgctatgaagggacagtgtccttcctccctgcacaacacacggtgggatctccaagggataggaagccctgccgggcaggatgctttgtttgcaggcaaagcaagcagcagctggaggaggagcagaagaaagcactgtatggtttggaagctgcggaggacgtggaggagtggcaagtcgtctgtgggaagtttctggccatcaatgccacaaacatgtcctgtgcttgtcgccggagccccaggggcctctccccggctgcccacttgggagacgggtcttctgacctcatcctcatccggaaatgctccaggttcaattttctgagatttctcatcaggcacaccaaccagcaggaccagtttgacttcacttttgttgaagtttatcgcgtcaagaaattccagtttacgtcgaagcacatggaggatgaggacagcgacctcaaggagggggggaagaagcgctttgggcacatttgcagcagccacccctcctgctgctgcaccgtctccaacagctcctggaactgcgacggggaggtcctgcacagccctgccatcgaggtcagagtccactgccagctggttcgactctttgcacgaggaattgaagagaatccgaagccagactcacacagctgagaagccggcgtcctgctcacaaactgggaaagtgtgaaaactatttaagataattattacagaccaattatgttgatatatacatttaaatgtagaaatttatttttgatagttaaatcttgattttagaagaaaacccttttgtcaacaattttgtgtacatatttggcattttcagttctgtacgcatctgcgggttgcagcccacgccgcttactctcagcggatgcagctgctcacttgggggcactggcctcttaggttttaacgatgtcaacagtgtagtttagaaaatggcccgttagtggctctattgcaataatgttagggacattatatgatttccacgcaggtcacaccatctgggcctgaggtagcagtgggtcactttgatccactttgcaggacttattctgtaacggtttgtggccaagttttgggaagtggttgattctctttgccttcatttcaccttcctcttcgtttacggttaggacatcgctgcttgatccttacaatactgtgcaactgcaatgcaacgtggccctgcttcaggtgatccgcgggaggggcctccacgccagcgccgggaaggctgctggggcctccacacctgcctcatcacggcggcgaggctacgacaatccggctgggagcatgaccttggcgtctgttctgggagcacggatgataagctctggaagctggcagtgtgtaaagcactggcaagtttgttactgttaaaatgtcaaataccaatgctttatatcgacgcgaagtgcttaacacagccgggcttgggggcagtcaggaggaagctggccatccgtggaggaggggccggtcctggactcccgcaggactcctctgatgcagggcctgaagtctgtacacgtggtccagatttgtccttgtcttttcttcacactgagttctctatatttattgaacatcttgtccttttaagccagagtagtgtaaactgcgtctcggatgtctgtcttttgcctcgaagccacgatggatcgctggtttcctctgcagcgcgagggctccggcgaccagaggattcttcccggaaggcattcctgccgcgctccccggggcacccctcaattgtgtactacgtccttgtttagtgtgtatccgtgcccacgtagatgatgtctgtaacgtagttttgtttgaaatatgagaatatgcggcttaaactttgatctgtaaggagcggggccgtggccgtttggagcacgctgtagacaccgttcctcatgctgccgggtgggttttgcagaagctcccttagtgatttcatgtttaacaggcagcatccattttcagaatttcctggcattgatttatattttgaagcatacaggaaacttctcgtttcctcgtttagccccacccagatcaggtgaaagggcagctttaatggtggtttttatggaccacattatcagagagcactgtgcaagccaaatggttcaataatgaatgaaaattctgggtgtaaagagtaaatatgccctggctctttctaccaatgtttgctcctggttggaaagaaaccaaagatttaagacgggctgctcttccagactggctgtgcctgcctgtgcccagcaacctgtgcagccggcagtgtgcctggtgtcacgccaggaggctgtggctgctgtgggccctctggaattgtgctcctcacaaagtttccccaaaaggttcttctaagcctttattgtccctggtaaatgtttcccggctgggcgcggtggctcacgcctgtaatcccagcactttgggaggccgaggcgggtggatcacctaaggtcaggagtttgagatcagcctgcccaacatggtgaaacctcgtctctactaaaaatacacaacttagccagtcttgttggcgcacgcctgtaatctcagctactagggatgctgaggcaggagaatcgcttgaacccaagaaagaggtggaggttgcggtgagccaagattgcgccactgcactccagcctgggcaaacagagggagactccatcgccccccctcaacaaaaaaaaaagtttcccatacactggcctgccccaaaacccactaacaattttagcaaaacagtccaggccaaagaggaagcatttcatgttcaataagaaacccagccattccgcatggctggttcctgagtggctctggtgatactctccagccacctgctgacattgagaatctcagacctcgggactgctgttgcggtaccgtgtgtctgacacctgccagcagccctttgctatctgcgcgcaggatgggggtgactgcccagacattcccgctagataggctctgatttccggggcagcctttcagatgcggcagacatacaacacctgtactttagagttttaagggaaaaaaaaatcagaagtgctggttagatagtaaaaacttaggataacttagaaaggctagttttagcttcctttgtggctccctggtgcatgaggccgggtttgacttcgttcctgaatacaatcttgagtaactgggaaagtctgagtgaaaggatggcctcattctctttctaatcttgctggtttcaagattagaaaatggcattatttgatctgaaatgtttgagaagacacgaataaagttacttgggcaga

SEQ ID NO: 304355 - DNA, 814 bp, Homo sapiens
caggggccgctaacggtccggcgcccctcggcgtccgcgcgcccccagcctggcggacgagcccggcggcggagatgggggcgacgggggcggcggagccgctgcaatccgtgctgtgggtgaagcagcagcgctgcgccgtgagcctggagcccgcgcgggctctgctgcgctggtggcggagcccggggcccggagccggcgcccccggcgcggatgcctgctctgtgcctgtatctgagatcatcgccgttgaggaaacagacgttcacgggaaacatcaaggcagtggaaaatggcagaaaatggaaaagccttacgcttttacagttcactgtgtaaagagagcacgacggcaccgctggaagtgggcgcaggtgactttctggtgtccagaggagcagctgtgtcacttgtggctgcagaccctgcgggagatgctggagaagctgagtacgtgtgtgtttggactgagagacaggatggccgtggtggcatgcgcatgcctgattgggtgatcttcctgaagtgtctccccgtttcgtgcagctggccataccccaggtggacatgatgagtcaggctgacttaatttctcatgagcagaccatcccagtgaatgcaaagggcatgggctccacagcctggaccctggcatggagtccagccccctgctcactggccaggaggcctgggggcgggtcacttacccttctgagcctcagtttctctttctggaagcggagatggtaatagcttttacattcgaggtgaatgtgagaattaaactgggcacatggaggaatacacctca

SEQ ID NO: 304356 - DNA, 412 bp, Homo sapiens
acatcttcttactacactttggtatagtgtacaattttggaagtaacttgtataataaggaaaaattataaaagagacgtaatctctttcaaagaaattattatttgccggcaattaaataccaggaacgctgcatgtcatcgcgcagactgtggcccgagagaggttcatgttcacgttccctgaggtcagcttgatcccgtcccataagagcgatgtagaattgaagagggaattttatctaggaaatccgcctgaaggtgttacaggaactcattttaaaagaatggatgatttgccttttacgtgaggactcacagatgtgaatataaactgtgtgatgtaatttttccccacagttactgaacatgctaatcaggccaaggagactctgtatgagattaacatagac

SEQ ID NO: 304357 - DNA, 304 bp, Homo sapiens
gctgccttccctcacggccgttctctcccacaggggactcgctggccatggatgtgtcctcagtccaccacaacagcacactccttcgctactccgtgtccctgctgggctacggcttctacggggacatcatcaaggacagtgagaagaaacggtggttgggtcttgccagatacgacttttcaggtaactcagaataatgcagactcgctccccgctggtcgtgccccgactgccttcacagatgttacctgactgaatccactgagcaccgtcagaggtgggcccccacctgctcacagac

SEQ ID NO: 304358 - DNA, 407 bp, Homo sapiens
aaaacttaggataacttagaaaggctagttttagcttcctttgtggctccctggtgcaaaacaattagcagttatgcaatggacctgattctagtttattctaattaagaagtgaggccgggtttgacttcgttcctgaatacaatcttgagtaactgggaaagtctgagtgaaaggatggcctcattctctttctaatcttgctggtttcaagattagaaaatggcattatttgatctgaaatgtttgagaagacacgaataaagttacttgggcagacttggcttgctttctttcctttacacatacctgttattttcaaagcagaatatttttcatgaaaacacacacaatttaaagaacaagaataaaatgaagcaaggtgtcaccaccacctatgccaggca

SEQ ID NO: 304359 - DNA, 873 bp, Homo sapiens
gattcacatccattggtcaggggcaaataccactagctctgcatcctcagtcactttgtgccatttcatcaggtcagagccaaaggaaagcttgaaaaatgaagacattagcaggacttgttctgggacttgtcatctttgatgctgctgtgactgccccaactctagagtccatcaactatgactcagaaacctatgatgccaccttagaagacctggataatttgtacaactatgaaaacatacctgttgataaagttgagattgaaatagccacagtgatgccttcagggaacagagagctcctcactccacccccacagcctgagaaggcccaggaagaggaagaggaggaggaatctactcccaggctgattgatggctcttctccccaggagcctgaattcacaggggttctggggccacacacaaatgaagactttccaacctgtcttttgtgtacttgtataagtaccaccgtgtactgtgatgaccatgaacttgatgctattcctccgctgccaaagaacaccgcttatttctattcccgctttaacagaattaaaaagatcaacaaaaatgactttgcaagcctaagtatggatgacagcattaacggccttcaccgctttacacacttcctttaaatttttacattgttaaatgttagcactgagaatgaaacttgaatgccaaagcctggttcatgaatcaatagttttttgttatttaaaaatttgagagtttgctttaacaattataagaaaaacaacaaataagcaatggtcatttcaaaaccatataggtgatgttttcaaatgagcaatttaaactaaatatgcataataaataattatattgtacatgctggaa

SEQ ID NO: 304360 - DNA, 1553 bp, Homo sapiens
gattcacatccattggtcaggggcaaataccactagctctgcatcctcagtcactttgtgccatttcatcaggtcagagccaaaggaaagcttgaaaaatgaagacattagcaggacttgttctgggacttgtcatctttgatgctgctgtgactgccccaactctagagtccatcaactatgactcagaaacctatgatgccaccttagaagacctggataatttgtacaactatgaaaacatacctgttgataaagttgagattgaaatagccacagtgatgccttcagggaacagagagctcctcactccacccccacagcctgagaaggcccaggaagaggaagaggaggaggaatctactcccaggctgattgatggctcttctccccaggagcctgaattcacaggggttctggggccacacacaaatgaagactttccaacctgtcttttgtgtacttgtataagtaccaccgtgtactgtgatgaccatgaacttgatgctattcctccgctgccaaagaacaccgcttatttctattcccgctttaacagaattaaaaagatcaacaaaaatgactttgcaagcctaagtgatttaaaaaggattgatctgacatcaaatttaatatctgagattgatgaagatgcattccgaaaactgcctcaacttcgagagcttgtcctgcgtgacaacaaaataaggcagctcccagaattgccaaccactttgacatttattgatattagcaacaatagacttggaaggaaagggataaagcaagaagcatttaaagacatgtatgatctccatcatctgtacctcactgataacaacttggaccacatccctctgccactcccagaaaatctacgagcccttcacctccagaataacaacattctggaaatgcacgaagatacgttctgcaatgttaaaaatttgacttatattcgtaaggcactagaggacattcgattggatggaaaccctattaatctcagcaaaactcctcaagcatacatgtgtctacctcgtctgcctgttgggagccttgtctaatttcagataatggttagcattacgatggctactataaataaaccattcttactgctctcttccaaaacaaaactcagcatgatactttgagattgtgttctgagagatgatatgactacataaaatacaattaaaaatgtttataatgaaaatgtagtaatttaagaaaacaccagatgagttaggaataaacctataacatttacaaaaagagcaaaactaagtgatagaaaatatttcacacatgttcttatagatcatgtatcacttgcaagttttaggagttcatatcctatatcatttcaaattaagtacataataaagtaaaattttgaaatgaacactttaggtatttttgccaagatttagatgtttttaattaaacttttctcttcctttttttttcactaaagcatgtttattcccctaatccattaaagagcatgaaaaaaagaataaatgtatttgaaaattaaaaaaaaagcc

SEQ ID NO: 304361 - DNA, 2935 bp, Homo sapiens
agagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcggctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaagcgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304362 - DNA, 717 bp, Homo sapiens
tggatggccctctttgctgaggacttggtgaatgtttggagcagggtaagctagcagtagctgggtctttattcagcacttatttgctgtgcatcttgtgcatgggcctctgaaaataaggaactggatatagtcccaggccctgcatttgggggatcaggtccaggagggaactggagacaggaactgagtttctatcaagggggatgtccttgaggcctgcatgtaggggggagtccagcaatgccaccctgcacccagggaagtggggttttgctgaccttgttaactactgttagctcctggtttctcatccacccactttactcctttccagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccacccgcccagctcgctgtatgagcccaa

SEQ ID NO: 304363 - DNA, 789 bp, Homo sapiens
tgctgtacaggtttgtacagcaaacctaggagcaaagggctgttctatacagccttggtgagttgtagactatactgtctaggtgtgtgtaagtatactctgagatcttcacacaatgacaaaatctcctaatgatgaattttctcagaaagtatccctgttattcagcgatgcataactctgtctctctctctgtgtgtgtgtgtgtgtgtgtgtgtgtgtgtgtgtatgcatgtgtttatcctggaagtaagtaatacagttgttactgccacaactagagagcatttgtgctgtgcgccttgtttgattgatgaggtcgatggtgtgttacacccatttgatagctggagaagctgagcctccgtgggttgaagtgacttgcccaaggcaggcctgcaaagcagcgggcttcctacttctcctgcacttcctctttctccttcccactctctctaggacccgataccgtgtctgctgtgctggaacctcagttttgcatggggtggggccggggagcagcagcctgctctgctgcccacactgcctttttctgggtacttctctcaagctttggtttgccttggaaagttcctagtgtttcagattgctgggatgtctgtctcactttgtgtcttgaattgcagctaaacaaccctgagatggtggagggccttgtccttatcaacgtgaacccttgtgcggaaggctggatggactgggccgcctccaagaggtgaggtgggggcctgtcaggccggcgggatccctgcaagaagagggacaggt

SEQ ID NO: 304364 - DNA, 716 bp, Homo sapiens
ggcctcgggtgatctggctccccagcaactgactgcattttctctccttgtctctcgcagccggccaagctcgctgaggccttcaagtacttcgtgcagggcatgggatacagtgagtatggcattccccgtgtgcagtgggtcggggcatgtgtcggaattggaagtgctctgtcctgagccaggtttggatgagcaattctgtgtccccctggccagcttcagctttctgggaggaaacagttaggtgtgtggagggcatgtggcagcctggaggatctagcctctcatttatcagtgaggctcatttttcctcctttgttgaatagaagttgtttcacaccagggattttggggggtttagatgaggactgtccctttaagcaccaagacaatgaccaacagtgaaacaataacatttttaaaaattttgatcacaagttttaagagaccactagctacagtgatgatgaagatggtgtcgatgatgatgaaagattactaacacattattttatctcactgaaccatcacagtactcctttgacatattcttagcccatcttatcagtgatgaagctgaggcttcggggttgtaagcagggagcagagggcggatctgtggaaattctttgaagactgtgaagctctgtggaagtggctaacaaagttgcttacattccaggtggagcatgccatagtcaagtcatgagctt

SEQ ID NO: 304365 - DNA, 963 bp, Homo sapiens
tcttggggaatggagtgaaattatctgtagggcctagcatagtgcctggcacgtagcaagctgcaagtgatggttgccacggagacaccagcagccttgcctggtggggctggattgttccctacccacggtccaccctgttcctcctttgtaaggcaggacaaggcagggcagggcagcgggcggatgggcatcctttcggaaaaaattcatagagcgcagagggccttggctgtggtgtttggcactaacgagcttccctctctcctagatggcggactgtggcggcctcccgcagatctcccagccggccaagctcgctgaggccttcaagtacttcgtgcagggcatgggatacagtgagtatggcattccccgtgtgcagtgggtcggggcatgtgtcggaattggaagtgctctgtcctgagccaggtttggatgagcaattctgtgtccccctggccagcttcagctttctgggaggaaacagttaggtgtgtggagggcatgtggcagcctggaggatctagcctctcatttatcagtgaggctcatttttcctcctttgttgaatagaagttgtttcacaccagggattttggggggtttagatgaggactgtccctttaagcaccaagacaatgaccaacagtgaaacaataacatttttaaaaattttgatcacaagttttaagagaccactagctacagtgatgatgaagatggtgtcgatgatgatgaaagattactaacacattattttatctcactgaaccatcacagtactcctttgacatattcttagcccatcttatcagtgatgaagctgaggcttcggggttgtaagcagggagcagagggcggatctgtggaaattctttgaagactgtgaagctctgtggaagtggctaacaaagttgcttacattccaggtggagcatgccatagtcaagtcatgagctt

SEQ ID NO: 304366 - DNA, 408 bp, Homo sapiens
ttagaatggagggcaacattccacagctgccctggctgtgatgagtgttcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagagaggctgagtacggatgggaaactattgtgcacaagtctttccagaggagtttcttaatgagatatttgtatttatttccagaccaataaatttgtaactttgca

SEQ ID NO: 304367 - DNA, 464 bp, Homo sapiens
tggatggccctctttgctgaggacttggtgaatgtttggagcagggtaagctagcagtagctgggtctttattcagcacttatttgctgtgcatcttgtgcatgggcctctgaaaataaggaactggatatagtcccaggccctgcatttgggggatcaggtccaggagggaactggagacaggaactgagtttctatcaagggggatgtccttgaggcctgcatgtaggggggagtccagcaatgccaccctgcacccagggaagtggggttttgctgaccttgttaactactgttagctcctggtttctcatccacccactttactcctttccagatctcaggatggacccaagctctgccggacatggtggtgtcccacctttttgggaaggtgagttgcgtggtctggcaaatctgttgttcctgctgagcaaggcattgtgtggtgctcagcacagggc

SEQ ID NO: 304368 - DNA, 526 bp, Homo sapiens
ggcctcgggtgatctggctccccagcaactgactgcattttctctccttgtctctcgcagccggccaagctcgctgaggccttcaagtacttcgtgcagggcatgggatacagtgagtatggcattccccgtgtgcagtgggtcggggcatgtgtcggaattggaagtgcttggcttgatgaaccctttgcacacctggcatcagtgctcactgtacgcttctcatcctgctcagtagacatcccagatttgtgggtgagaagtaggggctcagagaaatatgtgagctgcggatgtggcattgaccccaattctttctgaattcaaaactagctctttaagacaattcagcaaggattaattctgtttgggagtgcctgacatcaaaagcccctccctgtgcctatcaaggagataacataagccctgcatgcttggtgtggatcaactgcccctgtttctgatgtctgactcagtgtggcctcctagccatgatgcttcagttgggtggagtactagtttccta

SEQ ID NO: 304369 - DNA, 3058 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304370 - DNA, 2918 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccccggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304371 - DNA, 3174 bp, Homo sapiens
tagtcacaggtacagtaacctgtggggccagtggggcctgagggcaaggaagcaaggaagcgcaggcttgatggcctgttttccagatggagcaaacagtccggggcagagatggtggcgggcaagccctttccccagcatttggtgcatttaacagcgcagtctgagccaggcctctgtcccctgcctcctgggagtcccctcctagccctggtccttggagtggcttctggccagagagagctgctgcccgaagccggggctcttatggccagatgagaagagagcttcctcaaaacacagttggaaacaggctggctgtcttcagccacgcggatgccatgaaccccacatgaccagcccactgtctgctgtgtctcctcaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304372 - DNA, 2741 bp, Homo sapiens
actacatacttccgaccctggagcctccgtagacctaaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304373 - DNA, 2688 bp, Homo sapiens
tggatggccctctttgctgaggacttggtgaatgtttggagcagggtaagctagcagtagctgggtctttattcagcacttatttgctgtgcatcttgtgcatgggcctctgaaaataaggaactggatatagtcccaggccctgcatttgggggatcaggtccaggagggaactggagacaggaactgagtttctatcaagggggatgtccttgaggcctgcatgtaggggggagtccagcaatgccaccctgcacccagggaagtggggttttgctgaccttgttaactactgttagctcctggtttctcatccacccactttactcctttccagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304374 - DNA, 2081 bp, Homo sapiens
ttttatctgaaggctgcagggatcaagtcttctctggggctggcacgtagaagagcatgtggctggtggacgggcatgcctggctcctcacctggcagtctcctgccctctaaccggctgtctcttgttcccctagtgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304375 - DNA, 1701 bp, Homo sapiens
ttagaatggagggcaacattccacagctgccctggctgtgatgagtgttcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304376 - DNA, 1949 bp, Homo sapiens
attaaacaaaatccttttctcatttggggaggggggtaatagtgacatgcaggcacctcttttaaacaggcaaaacaggaagggggaaaaggtgggattcatgtcgaggctaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccagcgagggcacccgcagccgctcgcacaccagcgagggggcccacctggacatcacccccaactcgggtgctgctgggaacagcgccgggcccaagtccatggaggtctcctgctaggcggccggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304377 - DNA, 3004 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304378 - DNA, 3519 bp, Homo sapiens
  misc_feature (3141)..(3141): n is a, c, g, or t
  misc_feature (3374)..(3374): n is a, c, g, or t
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcaaaaaaaaaaaaaaaaaatgtacccctccatggatcagctggctgaaatgcttcctggagtccttcaacagtttgggctgaaangcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtacgtggaagtggtccacaccnaccgccagcacattgtgaatgacatgaaccccggcaacctgcacctgttcatcaatgcctacaacagccggcgcgacctggagattgagcgaccaatgccgggaacccacacagtcacagtatctacattaccgggtccggctca

SEQ ID NO: 304379 - DNA, 3457 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcaaaaaaaaaaaaaaaaaaaaaaaaaaaaaaaaaaaaaaaaaaaaaaaaaaaaagagggggggggcgcggcgccaaaagaattcccccgcgggggggcgcccaacttgtcgcgcgcgccacccacgcagtttttttgatgcgcaacaagaggggggcccccccaattggagagggggggccgctagatattaaataagacgccgagcggagcgcggggggcgcgccgcgtgtataacaaacccacggtgcgcggggagagggggagaaacaaaaccggcgcgcacagcgcggggggagactaccctgtggggggaagaaggggagccctccccctcaacgacgcggggggggggggaggagaaaccattgtggggggggcaacaaacctcaccccctacga

SEQ ID NO: 304380 - DNA, 3363 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcaaaaaaaaacaacacgacccacatacagccatcaatctccgtctgaaactgcatgctcaacaacacccaccacacacgttgtttgctggcgcccatgcccgccccgacagcaaggtcgttgaacacccactcgtggggcggcagcggccagcaacgacggctgcacaacattggcacagcgttctcgcaagaaaccatcgcggtccaactaggctgctgcgtctaccacaaaaaacgcgccggcggcaccggctgtgcacaacacccgtggggtagagccctagcgcactcacggccccggcgcaa

SEQ ID NO: 304381 - DNA, 1364 bp, Homo sapiens
attaaacaaaatccttttctcatttggggaggggggtaatagtgacatgcaggcacctcttttaaacaggcaaaacaggaagggggaaaaggtgggattcatgtcgaggctaaacctcgcctggctcccagctggtgctgaagctcgtcagttcaccatccgccctcggcttccgcggggcgctgggccgccagcctcggcaccgtcctttcctttctccctcgcgttaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcaggctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304382 - DNA, 2969 bp, Homo sapiens
  misc_feature (2810)..(2810): n is a, c, g, or t
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcgggagctaagctcccaacaagattcttttctgtttttctgagacagggtctcgatctgtcatgcccaggctggaatgcagaccttgtctcaaaaacgaaacaaaacaaaacaacaacaacaacaacccccccaccaaaaaaaaaaaggagaaggagaaaaaattttttctccagaaattaattccattggaagggccgacttatccccatttattttcccccgggaaggcttaccttttctctcacaattaggtgtgtaaaccccatttttaaccatacttnagacttttaaattttggtggtctaattttggaaggcgggtcatctaaattatcgggagatggagactttctatgaaagaggcttatacccttttaaaattgtcggggtcttaaaaaacagaaccggtccgggataaaggaaaggagcggtgttgaaggt

SEQ ID NO: 304383 - DNA, 1717 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacagtgagtatggcattccccgtgtgcagtgggtcggggcatgtgtcggaattggaagtgctctgtcctgagccaggtttggatgagcaattctgtgtccccctggccagcttcagctttctgggaggaaacagttaggtgtgtggagggcatgtggcagcctggaggatctagcctctcatttatcagtgaggctcatttttcctcctttgttgaatagaagttgtttcacaccagggattttggggggtttagatgaggactgtccctttaagcaccaagacaatgaccaacagtgaaacaataacatttttaaaaattttgatcacaagttttaagagaccactagctacagtgatgatgaagatggtgtcgatgatgatgaaagattactaacacattattttatctcactgaaccatcacagtactcctttgacatattcttagcccatcttatcagtgatgaagctgaggcttcggggttgtaagcagggagcagagggcggatctgtggaaattctttgaagactgtgaagctctgtggaagtggctaacaaagttgcttacattccaggtggagcatgccatagtcaagtcatgagctt

SEQ ID NO: 304384 - DNA, 1191 bp, Homo sapiens
  misc_feature (947)..(947): n is a, c, g, or t
  misc_feature (1033)..(1033): n is a, c, g, or t
  misc_feature (1036)..(1036): n is a, c, g, or t
  misc_feature (1076)..(1076): n is a, c, g, or t
  misc_feature (1090)..(1090): n is a, c, g, or t
  misc_feature (1093)..(1093): n is a, c, g, or t
  misc_feature (1160)..(1160): n is a, c, g, or t
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagcggcgcgactggagatgagcgacgatgcgggaacacacagtcatctgcagtgtctgctctgtggtggtggggcgctcgnctgcgtgatgcgtgtgagtgcactcatattgaccacaagacactctctcagatggcggctgtgcggctccgcagatctccagcggncangctcgctgaggcttcagtattcgtgcaggatgggtaatgnctcggtagcatgancgnctgatgcgtccgccagctctggttcagcgtattttggtgacgcgcgtcaacaggaggacgagcgtcnacagaggacgagcgtcgcacacagggcactg

SEQ ID NO: 304385 - DNA, 834 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggtgagttgcgtggtctggcaaatctgttgttcctgctgagcaaggcattgtgtggtgctcagcacagggc

SEQ ID NO: 304386 - DNA, 700 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcaggcttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304387 - DNA, 731 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggtaagagcgaaggatcagctccttctctgtctgcagagaagcctggtttctagcatcttcctgccccttggctttgatctggactgaccactaaaattaaggttgcaatttagagatgaggcaagaaattagctcgtcactctgtgaacactgttcttcacacagtctctga

SEQ ID NO: 304388 - DNA, 566 bp, Homo sapiens
tgtagtcccagctactcaggaggctgaggcaggagaatggcgtgaccctgggaggcggagcttgcagtgagctgcgatcacaccactgtactctaacctgggcgacagagcaagactccgtctcaaaaaaaaaaaaaaaagagaaaaggaaagcctgcctttgtgaggaattaaggagaccccacaaaggaggaagtgtaggtacagattcaggtcatagaaaggcccatatgtcccaatattatttctcttacagagaaaacagatgaaattgacaattttttttgtcttttcacagaccatcaccggcctcctgcaagagtttgatgtccaggcaagtagaggatgtggctttccttccccttcctcatcccgtcttctctttttcctttttctttccattggtttaagtagatcattgtgcaaacattgcgggcaaggggagagaaggcagtggtctcagctaggtcctcaccctcagctgctgctcccagacagaagctgacttgagtgctggccaaagaatcaggaaccagtcacttcccacgaaagcaggacagagacac

SEQ ID NO: 304389 - DNA, 326 bp, Homo sapiens
ggtgtctgtgagcctcagtatcctctcccaggaaatccactgcgctggccccaatgggaagactgggttgggtccatgggctgtgtgtacaagggacctcctcatcccctgcagtgcatcacgagggaggtgaagctgctgggcagagcgcaggcctggccttcttgccattggtcttggatttgcttcctttaggaaacctctcagcaggaagtgttgaccttttggcctttgtctccttgcaggcaggtgacagcagggacatgtctcgggagatgcaggatgtagacctcgctgaggtgaagcctttggtggagaaaggggag

SEQ ID NO: 304390 - DNA, 2304 bp, Homo sapiens
tcttggggaatggagtgaaattatctgtagggcctagcatagtgcctggcacgtagcaagctgcaagtgatggttgccacggagacaccagcagccttgcctggtggggctggattgttccctacccacggtccaccctgttcctcctttgtaaggcaggacaaggcagggcagggcagcgggcggatgggcatcctttcggaaaaaattcatagagcgcagagggccttggctgtggtgtttggcactaacgagcttccctctctcctagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304391 - DNA, 446 bp, Homo sapiens
gaaacaaaatgaatgtgctttgccaccgagacacctaatttttttctcatcttacttttttctcttctctccctcactgctgttcttcagacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggtaagagcgaaggatcagctccttctctgtctgcagagaagcctggtttctagcatcttcctgccccttggctttgatctggactgaccactaaaattaaggttgcaatttagagatgaggcaagaaattagctcgtcactctgtgaacactgttcttcacacagtctctga

SEQ ID NO: 304392 - DNA, 3136 bp, Homo sapiens
attaaacaaaatccttttctcatttggggaggggggtaatagtgacatgcaggcacctcttttaaacaggcaaaacaggaagggggaaaaggtgggattcatgtcgaggctaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304393 - DNA, 2962 bp, Homo sapiens
  misc_feature (35)..(35): n is a, c, g, or t
tctctccccaggtaaaaggcagctcggcacgtccnttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304394 - DNA, 3085 bp, Homo sapiens
tgctgtacaggtttgtacagcaaacctaggagcaaagggctgttctatacagccttggtgagttgtagactatactgtctaggtgtgtgtaagtatactctgagatcttcacacaatgacaaaatctcctaatgatgaattttctcagaaagtatccctgttattcagcgatgcataactctgtctctctctctgtgtgtgtgtgtgtgtgtgtgtgtgtgtgtgtgtatgcatgtgtttatcctggaagtaagtaatacagttgttactgccacaactagagagcatttgtgctgtgcgccttgtttgattgatgaggtcgatggtgtgttacacccatttgatagctggagaagctgagcctccgtgggttgaagtgacttgcccaaggcaggcctgcaaagcagcgggcttcctacttctcctgcacttcctctttctccttcccactctctctaggacccgataccgtgtctgctgtgctggaacctcagttttgcatggggtggggccggggagcagcagcctgctctgctgcccacactgcctttttctgggtacttctctcaagctttggtttgccttggaaagttcctagtgtttcagattgctgggatgtctgtctcactttgtgtcttgaattgcagctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304395 - DNA, 2632 bp, Homo sapiens
aagatttgcctacgaaagggacagtgatgaagctaagctctagatccaggatgtctgacttcaaattgaaactcccaaagtaatgagtttggaagggtggggtgtggcctttccaggatgggggtcttttctgctcccagcggatagtgaaacccctgtctgcacctggttgggcgtgttgctttcccaaaggttttttttttaggtccgtcgctgtcttgtggattaggcattattatctttactttgtctccaaataacctggagaatggagagagtagtgaccagctcagggccacagtgcgatgaggaccatcttctcacctctctaaatgcaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304396 - DNA, 1974 bp, Homo sapiens
tgcggtaccgtcaggtggtgtgtcaattgtggtcaggcaggcactccagagaatacgtgcaccagttacggcaggaatgctatgcgttgaatgggacacagcgcttcctggaaagatacatctacaaccgggcagtgagttcgtgcgcttcgacagcgacgtagtcgtggagttccgtgcggtgactggagctggggcggcctgatgaggattgtcctcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304397 - DNA, 2063 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaaggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgca

SEQ ID NO: 304398 - DNA, 2141 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttggcagtttggtgtctctgagggcgcgggcggccg

SEQ ID NO: 304399 - DNA, 1527 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacagtgagtatggcattccccgtgtgcagtgggtcggggcatgtgtcggaattggaagtgcttggcttgatgaaccctttgcacacctggcatcagtgctcactgtacgcttctcatcctgctcagtagacatcccagatttgtgggtgagaagtaggggctcagagaaatatgtgagctgcggatgtggcattgaccccaattctttctgaattcaaaactagctctttaagacaattcagcaaggattaattctgtttgggagtgcctgacatcaaaagcccctccctgtgcctatcaaggagataacataagccctgcatgcttggtgtggatcaactgcccctgtttctgatgtctgactcagtgtggcctcctagccatgatgcttcagttgggtggagtactagtttccta

SEQ ID NO: 304400 - DNA, 949 bp, Homo sapiens
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagcctttcgattaccaggcattggtattagatactgtgatgtgtgcagttacttcttgcagtccttcccttgaccttgtggccttgaagttcctggcactcccagttccagattagaagtctgagacccagagatctcaggatggacccaagctctgccggacatggtggtgtcccacctttttgggaaggaagaatgcgaagtacgtggaatcccctaacggcgcattgggattgcttaaacc

SEQ ID NO: 304401 - DNA, 945 bp, Homo sapiens
  misc_feature (567)..(567): n is a, c, g, or t
  misc_feature (800)..(800): n is a, c, g, or t
agtcgccctccgcccgcacgtacaacaaacctcaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaangcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtacgtggaagtggtccacaccnaccgccagcacattgtgaatgacatgaaccccggcaacctgcacctgttcatcaatgcctacaacagccggcgcgacctggagattgagcgaccaatgccgggaacccacacagtcacagtatctacattaccgggtccggctca

SEQ ID NO: 304402 - DNA, 391 bp, Homo sapiens
ggcttggctggatgggagtgggagatttctccaggggaggggtcctcatgctaatgatgcatttgtttcctgcagccggcgcgacctggagattgagcgaccaatgccgggaacccacacagtcaccctgcagtgagtggcttttctctcccccagcacttgcagtcggggctgcccactataaaggtggccttgctggcagggccttctttctgagtgtggcaggacattgtgtcagtgagacctggatatattccacccagagactgagcattacccagcctgacttggacttctccctgtgccggtggcatccgtttctagggtgtccccatgacctaggcctttgatcttggagaaggatggttgattgtacttgggacagcattta

SEQ ID NO: 304403 - DNA, 2912 bp, Homo sapiens
ggcgagccccgcagactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaacaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaagaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgacattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaaccaagaagaaccaga

SEQ ID NO: 304404 - DNA, 1017 bp, Homo sapiens
ggcgagccccgcagactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaacaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaagagacgaagcattgctatgttccccaggctggtcttgaacttctggcctcaaatgattctcctccctcttcatcccaaagtggtgggatcctcctgcctctccctcccaaagtgctgagattacaggcaggacccattgtgcccagcctaaaaatctcttactattatagaaacaacacctgtgtattttatacaactagaaaatataaatgagcaaaaataacaaaataaaaacatcatgtttccaccaccagagtagcactcttagcaccttagtgcttattcttttatattatatgtatgtcatcatatataatgataaatgacatcttactgtgaaaactgttgaacctgctttttcaatcaagtgtatttttatatttcaatgtattttcaccttatctagtatctacactatcttcaaatttccccaattggccccaataaaatcctgtagtattt

SEQ ID NO: 304405 - DNA, 2963 bp, Homo sapiens
ggcgagccccgcagactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaacaagaaagaggctgatatgcagcagaagaaagaacccgttcaggacgactctgatctggatcgcaaacgacgagagacagaggctttgctgcaaagcattggtatctcaccggagccgcctctagtgcagccgctgcattttttaacatgggatacctgttattttcattatttagtcccaacccctatgtctccctcctcgaaatcagtgagcactcccagtgaagctggaagccaagactcaggcgatctggggccattaacaagaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgacattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaaccaagaagaaccaga

SEQ ID NO: 304406 - DNA, 1978 bp, Homo sapiens
ggcgagccccgcagactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaacaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagagtgaagtaactggccctcccataaattctagggaaccaggcctcagtgtttattactggaaatgcaccagctttgtggaagtttctggaaaggaatgttgtggaattggtgattaagtggaatagctttctcttctgtcccctggttcattgacttgatctaagcccaaggcaaaagtaagaggaggtctcttataatctgtcagcttccttctcacttaggacct

SEQ ID NO: 304407 - DNA, 183 bp, Homo sapiens
tgcagccgctgcattttttaacatgggatacctgttattttcattatttagtcccaacccctatgtctccctcctcgaaatcagtgagcactcccagtgaagctggaagccaagactcaggcgatctggggccattaacaaggtaagaattgtccctttaaaaggccatgatgggtgtcaatt

SEQ ID NO: 304408 - DNA, 3023 bp, Homo sapiens
ggcgagccccgcagactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaacaagaaagaggctgatatgcagcagaagaaagaacccgttcaggacgactctgatctggatcgcaaacgacgagagacagaggctttgctgcaaagcattggtatctcaccggagccgcctctagtgcagccgctgcattttttaacatgggatacctgttattttcattatttagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgacattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaaccaagaagaaccaga

SEQ ID NO: 304409 - DNA, 936 bp, Homo sapiens
  misc_feature (836)..(836): n is a, c, g, or t
ggcgagccccgcagactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaacaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagangtgaccgagggaagaaaaacaggacgaatcttcacatccgaggaattccacactttgaacgggcaaaaacgggatgaagaaccccgggggaataacgcat

SEQ ID NO: 304410 - DNA, 2972 bp, Homo sapiens
ggcgagccccgcagactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaacaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgacattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaaccaagaagaaccaga

SEQ ID NO: 304411 - DNA, 1977 bp, Homo sapiens
gtgtagtataccacgtgtatgtaggaataacaaagttttccttgtgttgtcatcttagcataattcatccttgtgacctcttccatttagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgacattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaaccaagaagaaccaga

SEQ ID NO: 304412 - DNA, 1229 bp, Homo sapiens
atgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgtgcatgcatgcatgcatgcatgcatgcatgatgcatgcatgcatgcatgcatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaaccaagaagaaccaga

SEQ ID NO: 304413 - DNA, 784 bp, Homo sapiens
gtaccagatggagacccaggctgagcagcaggagctggaaacccttccaaccaccaagatggctcagaccaaccctacgccggggtccctggggccatggaagataaccatctatgatcaggagaactttcagggcaagaggatggagttcaccagctcctgtccaaatgtctctgagcgcagttttgataatgtccggtccctgaaggtggaaagtggcgcctggattggttatgagcataccagcttctgtgggcaacagtttatcctggagagaggagaataccctcgctgggatgcctggagtgggagtaatgcctaccacattgagcgtctcatgtccttccgccccatctgttcagctaatcataaggagtctaagatgaccatctttgagaaggaaaactttattggacgccagtgggagatctctgacgactacccctccttgcaagccatgggctggttcaacaacgaagtcggctccatgaagatacaaagtggggcctgggtttgctaccaatatcctggatatcgtgggtatcagtatatcttggaatgtgaccatcatggaggagactataaacattggagagagtggggctctcatgcccagacttcgcagatccaatcgattcgccgaatccaacagtagctgattaaaagctccaagtacgataattcctcaagcatgagaccttgctaagcactctagaataagttttatgttctgctcacagacattgctttcaaatgttagctgctgaaatccacaataaacgtc

SEQ ID NO: 304414 - DNA, 4696 bp, Homo sapiens
aggagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggacccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacacgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304415 - DNA, 4587 bp, Homo sapiens
aggagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggacccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacacgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304416 - DNA, 4484 bp, Homo sapiens
aggagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggacccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacacgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacagctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatca

SEQ ID NO: 304417 - DNA, 591 bp, Homo sapiens
ggcgactattgctgagtacagatgtgatcaaaggaagatagtatcagaaactgcaggatggactaattacactgaaattgctcatttatgtgaataggtgtcaagggtctcagagctgccatggagatggttcaaagttagagtataatcaaggcactctttagttggctggtaaaagttattctcccacagatatatgtatagagcttttcttaaattattatcagtgttaatagcagagtgtgacttttaaagaagaatcttgagctgcccaggtgaaagcctccattccattcttgttctgcatctaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatgtaagagagcaaatcagagagaaaatttcttgccttttaaggaggccacgggttcccatgcatttccc
